United States Patent 8,071,291 (GENETIC POLYMORPHISMS ASSOCIATED WITH VENOUS THROMBOSIS, METHODS OF DETECTION AND USES THEREOF) - sequence listing, part 8

SEQ ID NO: 587 - DNA, 20001 bp, Homo sapiens
tctatttctattagtaagtggaatcagaaatggcttgcacttacatagcagggacagcaatatgctattacactcttgctccttgggtcacaagttgagttctccagaaagcactctctgagaaggagctaagcattcagagtgttaatcagcataaacatatctccataaagatcaacacctgcggaaagagtacggcagatgtttgcccaaggatgagagggaaaatctgtgaaagttcaagagcctacaatattgaggtttatggaggacaagtggtctgagtcatattgggacatccatctgaagtagaagagaagttactgtaccttgtaccactcagaatgctttatggtcctctttgggttattgaggcaacatctgccacattaggcatactgtatcaacccgcttactgggtaccttcataagttgacagttttgattggaacctgaaataagaaagaactcttagacagttcaggctgcagttcatgcagtcttgccacatggaccctgtgaccaagccaaaccaatggttctgtcagtggcagacagaagtgctatgcagagcatctggcaagccccaatagaagaatcacaagatagacaccctagagttttggaataaggctatgttctattctgccaacaactattcattagagaaaaatatcctgactgtgctggtcttggaacagattgaattcttgaccataggatatccaaattgccaaacttctgttttctgattcactgaaccataaaattggatgtgcacagtgcattgcattataaaatggaagtagtatatatcagggggtcagcaaattttatctatcaaagaccagttagtaaatattttaggctttgtgggccatatggttcctgctgcaactatttaactctactgctgtggcacaaaagtggctataaacaagatgtaaatgaatgaatatggcagtgttccagtaaaactttatttattgcactgaaatttgaatttcagataattttatgtatcatgaaatattattcttattttgatttttttccagccctttaaaaaatggaaggcccattcttagcttgcaaagaatgcaagctacaaaacaggtggcaggctggatttggtccatgggctgtggtttgtcaattcctggtatatatgaagccatacctgagcaggtacagaaggtacaacaaactgtcccaggatagccagtggctccaactcccatctggcatctgctcctactgctttgccttcaaccctctctatgatgaattaactgcagagaaaaagacgtaggctcagtttatggatggatctgtctggtgtgctggcaataggaaaacagggatgcctgctgtaccactatcccactgctggtgggctcaaccctgagctgtatatacagttaatcactttgtgtgtggggagaaatggcctcagaagtagatctacattcactcaagagcagttgataatagttttttacactcaggaacttggaaaggacactattggaatattgatcacaatgtggaaggggagatagagatgtggatgggcttcttggaatgaacagaacatgaacatatttgtgtcccaggtaaatgcccatcagagaccattcatagtagaagagcctctcaataatcagatggacaaggtgactcattcagtcattgtcagttactctttttctccagacactgaagtgcatgcttaataggctatggtgacaggaatagtggttgtacataggcttaccaactgtgtctaatcatcatcaaagttgtttgactattaccacttgcagagtggtacagacattaacagactgtggttgctgtaattgtccattaatagttaaaagtggacaagagaatagcaagagataccacaggggattacttgagtgagaaacatgtttctctatgccaaaactgtttagtagcaacttcataattttatagtgatttgttaactcctttggtgcctactgccctactgacacaatgatcccaaagttaccagatgccagctgtagatttcaatttagtgaaactcttaatgtgtaccctaagaacgagggcccctgaactcatagagccttgcagagatgagaggcacacattctccaagtgggttatgaggagtagcagtagaaagggacactcctgtttttactccctgattctctgaccaacatatcctactggggttacagcatcctatatcagcattggtttaaggtatatactgcatcctgaagaacatccactcatcatcaaagaatgacatctctaaaatggtgccttagtttcacctttaagagtccactctagtgctgtatcaagctgctgggtcctggataacgatgaatataataagaccaatggagtccatggtcatgagctcactgacctacctcctttgccaaacattgtcccttggtacaaagtgatgtgaaccaggaacacatgttagaaaacctgacactcaggagttctcatataggtatcagtcacagcatcatgggcagcaaagtcaaccccatgtttggaaagcacgtcaatccctgtcggtgttaacagtgcggaaggggcccaataacttgccaacactgggctaattaggttccctcagggatatactgaagtggggtgtcagcattgcctctattgacagcaggccacaccacatacccagcagtagaagtagctagatcagccttcgaaagagaaagtccaacttattaggtgcccctgcatagtatatatatatatatacacatacacacacacatatatagctatatatatatatatatatataagtatatatattagtgtatatatatatatatattagtatatatatatatatactagatcagccttggaaagagaaagtccaacttattaggtgcccctgcatagtatatatatacacacacacacacacacacacacacatagctatatatatctatatctatatctatctatatctatctatctatatatatatagccactgtggctacaactacatgaccagtgtacaaacatcggtgagtctggggagagagccaaccatctactggctgactcttcctctccacttagttgttttgtgcttcaatttcagtggaggctgtctggtgggcattgatgtgtgacacaaagatcctctccctttgtaccctcccccattggtctatccccatatttcttccctcggatctctttgtattcagtctttcaatcttgcttctttcagttcctgactaactagccaaactattcagcactgccactgagtctatacatattcttaggttggcttcttctccctccaccaaaagcgctgctcaccaggaggattttcccttatcactatttaggatctccacccacccccccgcccggggtgctatagtggaatagcaatccatttttgattcctaccaaaatattgagccatcccatctacgcaacaacccttgatcgactagtcatagagaactctgataaggccacaggagcaagccgaaggcaaggtatatatgcaatagtcatgggttacatgtggttctgggctacctattcgtgcagcttacttgtgccccttaggtctgcctgggcttgacacaaaatgcatcattttcattgtatgacagattgctcatgggccttcgcagttttatgagttggtgggtctgacagcacccaattcataatgggcacctccagtcaaatactcccttagtgaccttagtggtcatagcttggtttgcaactaaacctaataatatgccagcagttgcttttagcatggaagatagttctgtgctgcacatgcatggtcttaattcagaactttaggaggtccatattgcagcttgctattggagcttgctaagtactcctcatgatttattgatctatcatatatgcctctagtataatggggtataccttgtcatatggcataagcaacaaggtggtttgtactacagcctggcttatgcttgtattatagtcccaccagaacaatctgggtctctttcaaaactggcagccatctgcatcacttggtaaatggattggaacagtattcccaagtgtagtatgtcacctccaaaacatgaagaggcctaccgaatgctatgcttcatggtgttagaagatgccaagtgcaataacttgccccttaccttagaggcaatgtcctggcatgccccagactattggactcttgaaaaagtcactgtcgtggcgttctttaaatttgtatagaacttatatccctccctctggaatacctgggtcttatcagaccatccagagtacttaccgcttcttactcatctggtctgattaacatgatatcaacaatataacagatacatgtaatgttgtctagaatgttcagatggtccaggttcatttggcctttatcatgataaacggcaggagagctgaaggacaagactgcagatataatctgttgtccatcttagttaaatctgaattgcttctgatgcttctttctcatgggtattaaagggaatgcattcaatagtgcattcggtaccagaagctgagactggagtttgtccttggatacatttgtggtggtcctctgtcttctgacctacccagttttctgagggccagactggtgaaataaatgggagtacaatagtgggactaagacctcccattctacccaggatgtggcattgtttttaggttactgggggatgaattggaagcagagattgttccatcataactttagcttcctcctgccacggaattgatagggaaggaggttgttatttttcagacagagagaagccagttgtcagggtgttcagttaacactatgagcaaaactgaaagtaatactttattcactttctttgacagtataaacaagaggctaaacaagaaagggtgacagctccccaacatcccacttaccccttatgaaatggcatgggcaagggtaggatgcatccatgctgactaggggattgtctcatgctggaagagctctgaataaaaagttcctgctgttttatgttctctgggactgatgaggaggagaggtagaaggcctagtggtagaaaagtatagaatcctgagtcagactggaaaagagtgttgagggcccctcaataaggaggctttgtcagaagcatctgaacaatgtctcactggaggcctgtcccaataaaaaggcttccaaatggtggcaccaaggcaggaatacagataggcacaagagcatggctgacccagcaggcctgaattcttgcctgtaactccctgcaaagatggcaatgcagtagctgtgcactgagtctggtgtggggaaaacagatatcctcccccgccccatgctaccacccaccctcctacctccccagcctttgaaattgcctctgacagggcctgaaagattacacataggattttgacttgtagccaaactccccagttattgtgccgcctggataattgatcatgggggaaattgggttgctgctacaccatggaaaaaggaggactatgtctggaactcagagggctttcttttggtgggtggggcttgtactcctttttgtttagaattcctttctaatggttttattgatagaaaactgagacagtttaataaagacaagaccaccaaagacttgtgtacataagtgaagtttttggtctctaccaggtgaagaagcccattcaactgaggtgctggcagagagtaaggggaacatggaacgggtagaggagagaggctgttctgatgactagcctaagacacacacacacacacaccagtagtagctatatgtacaccatgtaattgctaaatgtcacctaactagtcattgctgaatgactatcctagacacacacacacacacacacacacacacacaccaggagtagttatgcatatatcactagactagccacacacacacacacacacacacacacactagtagttatgcatacatcatgtaattgctaaatgtcaatttagctcagttcaatcgttcaacatgaattttgtattgagagaacatatcctactctaccattctattccaactgcttttgagattacatggcataagcatgcaaacctgctatgattttgtagctgatgggacttcatgtgtactgtggcttgagacctaaagttttcaagtgagtggaggagaacgggatgtggaggggcagaaaatgggaactgtgatagatagcttccatttgttctagatcctcttgccatgtttttccagcatactgtttgctccaggaggcagttctgtatgaataacatcaaaaatccttcttgccttctgttttctcactgagcttggccaatgaggagaccaagtaggagaataagaggagggaggggtatgaggtgagggtatatattttttcagctttctctctgcaggtttgccttaagttggctgtgacccttgcccaaggtcatggttcctcccaaggtggtctctttcccataatactcccctttgggtttacagtaactgctctcttccttcattcttcaggtctaggggtattaacagctcctagcccctgggttctgtgctatcctttacatttttcctgcaccttatccatggctgtgtaaatacttattttggtaaacctggcttgaattatccccatttactaagatgcttcccagctcaccttcttcaatggagcctccatactactataagtgatatttctgaaaggcaaattttagcacacccctcctcttcctaaaattcttaatggctctctgtcacctacagaaagatagcatggctatctatttaaggaccactctccagctacctgacaccgtttcctcctacacactctgccttccagcgacactgaaccatgtacagcccccgcagaggagattctctttttgctcattaaaagatgagctagagttcttgaatgtctgtggtctgtttcttccttgggcttcagagtaactggtctaaatcattctccttttggagtaaaatcttcccttcttcccttggatgtcatcatttcctctgagttttaatccttacttctttcccctgtagaaaacctccctcacgagaggaggcaaatctttttttgaatttctgaactgccatgatacactggagacccatagtaacttaattattcctccaattccagctaaactctcaagaaatctctgagtaaataaattatcagattagggttttaagcccacacttattttaagatgcaacaaattaattaaaaattaatttgatcaaaatccagaatgtatacaagataagcaaatagaaccgtgcataccatcatatattgtccacgagttaagctagtctgctgcttttaacactctaaaactggatagaaagcaataactgacttaggccaaaatataggtaggcagcaagtataaattgatactcttttatgctataaaacctaatatacatacagaaaaaaaaaacctccacaaataggcttaatttttagttcaggttatagtagccaatagagctagaattgagggtttcttataattggtttgtatgagccatgctgctctgtggccccagactgtgccacaaaaatatctgctgcaaaatgaatgtctgctttttatataaaaaagtgctgcaaattataatatgtgtgttcggatacaaagaaaattagcatatcttttctatctctttttatacaaaaaaacataaacaggaccaaaaaacaatagatacagtgtctaagagctctttttaataatgatttttcaattttctctttggagaagcttctgagttcctcccttgtacttcaatgggcaagagtaggaaagaagcagaacagattattcatcttatgtgacttggagtttgtaggcttcaccataagctcatattggcttttagtcgaaatactgaatataagagcaaatatacttgcactagcatcttttgtcttattttcatgtgatctggacaaaagtgaagaagactggattgcttgctggaattcaggggaaaaatgtcaatttagcccagtgcaatcattcagcatgaattctgtattgaaagagcaacataacctactccactgttcaattccaaataatatttaattgctttctgaacctcttccaacttcaattagtgttaatttagtgtgtaactaaatacattaccctaaaataattaggaatggtacagtgtcctccataacatatgtgatttgtattagcagccttggttcagaaaagtcttaagctgggaaacagacacaaactactcaaaatgatctctcaacctcccccctctcccggctccgccaacccaacccacaagacaaacacagggacttaattagcaacagagtattttagtcatttatggggcacaggctcttattggttatataggatatggtccaaatgccttggcgtgatatactaggcccttcatgatctgacttctacttcatcctacactccaattccagcaatgtgacatggttttctcccacacctctgtatttttgtttttgtagtgctatctccctaaaatgccctcaccatctaactgaaccacttggcctccacctcctcacaccttcatccctgctggactgtggtttagcagtggctttgctcctttgaccaacgccacagctcccatggctacagctttcgcttgacactggaaacaaacctccgcatccttttcagcctgggggtgttaacttattccccttcctgttcatccttgggaccttcaccatccctgtgagctcctttaaccctgacctgtctcgttaaatagtccttccagtaaacccttgtcatgtagcctttgagtgtgctatttctctcttgctgggacgatgactaatacagttaggttctttatgacaccacctctttgggtagaatggaagttttgtgctctcactgaacccactgcagacttatatcatgcaaccaggcatatttgattgcaccatttattaagaagtttatgttcggccggatgcagtggctcacacctgaaatctcagcactttgggaggccgaggtgggcagatcacttgaggccagcagtttgaaatcagcctggccaaaatggcgagaccctatctctattaaaaatgcaaagactggagagacagcgggacggaggaatgggaaatgacgtaaggattgcagaggggcgtgaggtttcaagatggcggggctgaagggttgaccgccaggctgaattgaaggcccttacaaagtgaaagagggcaggaatcgcacctcttggctgctcgcagtcctgggagcacagcagaagtgtttttcttttcttttctttttctttttttttaaatgaacaagtaaaccatacaaattgtcaacatgggaaggagatctgcatcatccaccaagagtggaaaatttatgaaccccacagaccaagcccgaaaggaagcccggaacagaagaacaaaaaacagctcatgatggtttgagctgaagttttaaagatgaaggatcccaaacagatgatccgagacatggagaaattggatgaaatggagtttaacccagtgcaacagccacaattaaatgagaaagtactgaaagacaagcgtaaaaatagctgtgtgaaacctttgaacatattctatgactctatgaaaaagaggatccagatatttagaaagaattgagaaagctagaaatagagtatgaacagaagaggactcaaccaatatttgaatgctgtcgagaatgcccagcacgtggaagtggagagtattcctttaccagatatgccacatgcttcttctaacattttgatccaggaaattccacttcctggtgcccagccaccctccatccttaagaaaccctcagcctgtggacctccaactcaggcagtttctatccttctcttcttgggacgtggtgttccacatttgcctcctggcagaaaacctcttggccctccccctggtccaccccctcctcaagtcgtgcagatgtatggccgtaaagtgggtgttgccctagatcttccccctcctaggtgagatgaaggcatggtacatagtcctgaaattgcccagcgaggtcatgatgatgatgtttttagcaccagtgaagatgatggctatcctgaggacgtggatcaagataagcatgatgacagtactgatgacagtgacaccgacggatcagattgagaaagtgtgcgccatgatgatggtgggagagacaacaatgaaaaaaagaagtcaggtctgagtgtacggtttgcagatatgcctggaaaatcaaggaagaaaaaaaccatgaaggaactgactcctcttcaagccacgatgcttcgtatggcaggtcaagaaatccctgaggagggacgggaagtagaggaattttcagaggacaatgatgaagatgattctgatgactctaaagcagaaaaacaatcacaaaaacacaatcaagaggaactgcattctgatggcacatccactgcttcttcacagcagcaggctccccggcagtctgttcctccttctcaggtacaagcacctcccatgcttcaccattacggcctcctaggccacctatgaaccttccccctggaccacctccaggagctcctcctgagaccacctggaatgccaggactcggcctttaccctgacttttacctccacgaccaccgacttttactacctcccccacgtctacctccaagtctgccccctggtccccctcctcgggaacccccaccaaggatacctccccctgcacctccaggtattcctggagtttgtaggcttcaccataagctcattttggcttttagtccaaataccaaatacaagagcaaatatacttgctaatgcaagatattttgtcctggcacgatgcacccagctttggtacctccccttgggatctgcccccctgggcttttcccaccagctcccttgctgaaccctgagattttaagtgccccacccggcttgattcagcgatccaaggtagataatacaagtgcagccaccgttgagaagaaagccacagcaaccgtcactgccaaaccacagatcactaatcccaaggcagagattactcgatttgtgcccagtgcattgagagtacgtcgggagaataaaagggctactgctgcttcccaaagaaagtcagaggataattctgctgtgcctcttgccaaagcagcacccaaatctggtccttctgttcctgtctcagtacaaactaaggatgatgtctatgaggatttcatgaaagagatggaagggctactgtgacagcttttgatgccagaacaggcctctgttcacaacagtagcccatggagaaagaggctcttattaaacttagatgaaagagctgcttccattgtcagggtattttctaatttcagttcaaggaatatcctaaaatttagccttgttcagaatttgctgcacattaaagagggtatttcattcagaatagataagttattgaagcagtgctgctaacatccattccctttcacaccaccattttcaccctgcttcttcccctttggaaatttgtgatcgggggatcttagttgcttatttgttttgactctattcttatgtgctgtgggcactggagtagagatttctgaaaagccagtttatttcaccttgccttttgtgtttgggttatttgtaatgttttcctgtaaatattttataatattttgcttgtaatgaaatagatcacaatgtcatttcctaatacaaggcaggatatgtgggaagaaaatatacaattctttgattaaaattatttccaactgacatatatacatatatgtatatatatgttataggccaggtgtggtgttgagcacctgtagtcccatttacttaggaggctgaggcataagaatcacttgaacctgggaggccaaggttacagtgagccaagatggtgccattgcactccagtctgggggatagagccagaccctgttcaaaaaaataaaaaagtttatttttgtctagagtcaaatgaatgcctctcactaccaacagggtggagcagttcctgatgtatatttagtcctcagcaaatattttttaataaattgatgaatatcataaatattattattcacaataacatttttcttaatatttttatgtggcagttttcttacatacattatctcatttaacacaataattctgtaaggtgggattaacattcttgtgttataaatgagtaaactgaaatttagagagtatacatagttggtccaagtcatagtaaatgaaagaataaacctaggtcttttgagtgggtgtattttgctaatgttttctaagatttcctagtcccatcttgaacctcattcaggtacaaatatctgagtattaatgacactaacatggtcattcacaaagtataagatgtaaattttgtggtattatgtgcagattttgaaagatttaataggagaaactttacacagtttatgcatttgttgatatgtcaaactaattacctaatttttatttggaaatgagctaattcctttgccaatggggtgggatccataaaggagtgggaggggctggggaaccagtaataatacagttggaacagatttcaatcatccattcacagcagaaaaccacacaccttagacccatgccaagatttaccaaaccatcaatgcacttaaaaggtttactccttgatcatttgatagtgaaacacatggtttatggggttcatattatatactaatctcttttgttatcatttaaataaaaattctggagccttcttactgcaggccagctctgcacctggtctatgctccatatgtttgccctctcaccaaaagactcatactgatgtttaaaatgccaagaatagaaaagtgccacatatcacttatcaagtgatatggtttggctgtgtccccacccaaatctcatcttgaattcccacgtgttgtgggagggaaccagtgggaggtaatcaaatcatgggctgaggtctcccctgctgttctcctggtagtaaataagtctcacgagatctgatggtttttaaaagggtggtttctctacacaagctctcttctcttttctgccgctatgtgagacgtgccttttaccttcccaggattgtgaggcctccccagccacgtggaactgtaagtccaaaaaacctctttcttttgtaaattgcccagtctcaggtatgtctttatcagctgtgtgaaaacaaactaatacatcaagggatcatttccagtgaagattattgattgcttgcttgattgagacaggatctcactctgtcgcccaggctggagtgcaatggtgtgatcatggcttactgcagcgttaaactcctaagctcaagcaatcctcccatctcagactcccaattagttggaattacaggtgcacaccactatgcccagctaattttttaattttttgtagagatgagatctcactatgttgcccagggtggtcttgatctcttggcttcaaatgatcctcccatcttggcctctcaaagtgatggaataagtcaccttgcctggcccagtgcaaattttaaaaggagcgaaacagagaaattagacatttcctgactttgaggacttttttttttgagtgtcctgattatgacaaacaaggccttcattttggattaaatggaattatcatggtataacctttctaaatacatctatttgttcttcaaaatgtgaggcaattggacattttcatctatttcttcaatacatttttgtcacgggtgagtgatgactagctcggccagtggtgcaggggtaatagaatttaccacggcagttgtaggtaaagaacgcagatttattagagaaagtaggaaaatatcttgtgagaaggcaatgggcagaccagcagaagagaggctgactgcaaggaaacaaaggcttgctggagattttataggatggttcttgggttgattgataatgccaaagcagcagagagcttaaatggcattcttctgtcagccgaggcatttgataaattgaggcatttgagggtaagcaggaagtttgtgagttatgtatgttatctgtgcaggaggaccatctatcctgggccataaaggaaagcagacctatagctcatctccttcctcttttgtttatatgtcctggaccatgaagaaaggcagacttatagcttatttgctttatctctttactttcccttgctacctccaccagcctaactccttttccctaattagggctcctcaatatttactgagcacctactacagactagctgttcctactgcgtgggaatcatcactgaacaaatcaaaggtccctattcttgagaatctgtgcattttcatgaaaatgtattctgtacttatggaaaagtggaaggaagagttttcagacacataggctgccttaaattttattctccaattccaaaaaatttagaagagcacagaaattcttacaaaataacttaatatttagagttaacagatgatgcatacaagttgtcaggcatgttttagatacattaatttaatccttacgaaaactctatgacactactttcaatctcatagacaaggaaactgaggcaaagagaagtaaaaaaactcacccaatgtcatacaaattttcctgcagcagaatctggacttgaacctggttcattcatcctcattgtctttgttctaatgcaccgcaggattctgttttgctgtaattggcctttagtcaaagtctcgcagagggcccacacctgtaatcccagcaatttgggaggtcgaggtgggaggattgcttgaagccaggagttgaagaccagcctaggcaacataatgaaacccttgtctctacaaaaaattagctgggtgtagcggtgcacacctgtggtcccagctactcaggagattaaggcaggaggactgcttgagcccaggaggttgaggcagcaatgagctgtgattgtgccactgcactctagatgaggcaacagagtgagagagtgacagtctttctcaaaaaaaaaaaaaaaaaaaaagacgcagaagatttgaaatggattgagactcgtaaactcatttgataagatatcttgtgcattttaggaattctcccaagtggtcctggctcttcttgaaaactatacagaaaaatactatttcttcacatgacaaatcccttcgattatcagcagaaagccattattgcccttctcctttcccctctcccagtacttttaatgattcttttttttccctctctctcctttttaggttaaacaacttcttattccacaactatctagaagtaaaaattactataaattgaatgatgaaaacttcaggtcattcctttcaaagtcctttccagtgctgcatggagaaaaaacgcaatctacaaccacaacaataaatgaggtatgagatttaattctggatattacagggaggcttaatgaagcagagaagtggatttccggagaaggagagattaaagtctggaaaagaagtatacctgtctggggattaaaaaacaaacaactttgaacggtcaaggaacctggaaaccaagctcataaaaggtaacatctgtgcccttaaactaacttaaggtgagaaaatttaggtgagaaagaaattatttaaataaaatgttgccataaaaaatcatttgccttgaaaaaataattttcatgctgaggatccaaggactcattattagggaaattgtagcagaagtagatctggtgtatagttcagactctccagaggatagttacttctgataaaatggtaagtgtgaaagcacattaaaaagttaaaaataactatataacaactgtatttttgtttcatgaaaattttaattttggtgaaataaaaagtacctttggcagcacataacaggactaataaaatgtggaagccatttatttcaaacccactttaattagagtttaaaagttacttagataaacctgaaattatgggttaaaatggggtaaaaagtgtgtctaaaaatttttcaaatgttaaaaaacccaaacttaatacacaagaaaccccaaggagacaataagaaaatctaatggctatcttattcttccaaacttaatcttaacatgtatgttgtgggtacaataaattaaggctccatataatgaggttttaatttatttataagatatttttaaatgattacaatctggtaaataatacattggatgtgtattcactaatctagagatgaggggcaaaggtaatctcttcaggttaggtttgtttggctataatatgtgtttctgaaatgagaattagcaaaattagctcatatgggatggacaaattgagaaataatgtgaataaaatagtttatctgtttttcaagcacgttaatgctttgcactttcaagtacagtaacagcagcaaattggaaagtaagtgcagggttgaaagcagcaagccatagaggagcccagttttgtattttcacactcagatttccgcttccttgtttggcccggcgctctgtcttggatgtgcctgttgagagtgatactctcagatctttattcagttttctctgctctatcatttagcaacctcaactttccttatgtccacttctgtcaagctactatcattttttcttaaggtaatgtcttatatattccgtagcattgttttgtttatttaaaaatttagcatgtctctttaactgtataatgttttcttaaagaccgttattgatcctattagttctttgactgcaaagtttcgagtttactgctcctaattccattttccccatgcactttgtcgtatttagtgcacagttttggaggatgtgagatttttcaggaaatgcttgtaacttctaatatggtatgtccataaacttatgaccctgttcagatagtggttgccatgtatttagcaaatcttcctgagaagtctcaagtatacagtaatgagttatcaattgttggacactaaatctcaaaaaagacaaatccagccataaaaatagtgtgtcagagcaaatataaaccaaattatcaggatgcaaatatattattactttgatatggagagaataattgttttcgtattcaaattcatcttataaatactatgtggttgatagttatattgaagaaataattaacaaatttaggtttgtataactctatagcctaaatcagaaaaagcatgttcatctgtttttaaatacacacacattaaaccattaaatgatgactttgtatttaacaggacaactgatttctagttcttgacaagataacttactttttactagaatcatactaacatcttctttaaggaagagtagtagtaatttaagaaagcctgtgtttagtaacaaatttagaaaatctaagacattttgagttcacagaaaagaaaataaagattatttagaaaagaaacttgtagactttatgatactaagaaagaatgcattaataaaatgtaattaattatttcacaattaacttccttaagcctgtttttcatctgtaaatgaggagaataatgataatagctacctaaagcattattaggaggattaaatgagataatattgagcattgtaaagcacttatcacagtggctggtccatagtaaatcttcatttaaaagttggtaattattctaattggcaattaaaaatcccattgtttagaatggagatacattaatcaatcctgagattttaatatttgagtcatagactattttttgctactacaaggtgtcactctttaaattttctctctgaaaatgatgactattttataaagccaaaatccacaacaatgcatggagcaccgggtaaggcagtgaactaaatgttaatctggagacaaataaatgtaagatacaatccctgcaatcaaagtttacaaccagatcggacaaagaagacgtaagaaagtaactgtttggtttttctgcaatgcattagttacttacatggtactgatactcagagaatagtttttaccctttccccaagtaaaaattaaccctctcttaagctctttatcaaggttagcttaagtggtattattgtatataaacatatcacatactgcagaagctcccaaatcttaatgagttagcaaggacttaatgttaagaaaaaagatagttagaagatactgtctgtcattacaacatattaaatgccaaagacaaaaagacgtaaaaagcctcaagcaaaaaaagatttcataggcattctgatatctttcacctgtattattgcaaaattctgagttagtcttaccacttttaatctcttctgattccagttcatcttacacatatctgcttaaaataggtagttttctcttttgcaagaatatgaagcaattttctggtcaggatcatatcagacttaagggctttaggcttacaatcatgacatcttattaaacggtaaaccactcttctatcttgtcctacacttgaacaaatctaggctcaatgccatggcctactaaatttaaaaaatccatgaaaaaagcaaaacgaggccaggcatggtggctcatgcctgtaatctcagcactttgggaggctgaggcaggcggatcatgaagtcaggagttcgagaccatcctggccaacatggtgaaacctcatctctactaaaaatacaaaaattggcggggcgtggttgcgggcacctgtaaccccagctactcaggaggctgaggcaagagaatcgcttgaaccagggaggcagagtttgcagtgagctgagatcgtgccactgtactccagcttgggtgacagagcgaaactccatctcagcacattgggaggctgaggtgggcagattgcttgagcaagagttcaaggccagcctgggcaacatggcaaaaccccatctctacaaaaaaatacaaaaattagccgggtatggtgatgtgtgcctctgctcccagctgttccagagcctgaggcagaaagattgcttgagcccaggagcttgaggctgcaatgagctgagatggtgccattttactcccacctgtgtcacaaagtgagatcctgtctacagaaaaaaaaaaaagtatattctttacatatacaggatgaactgatagatttttattttatactttgggaataatcctctactattttatttattttgttgctcaaatggttccagctttggccactgggagccctttcagctggctcctgttcccctttcatgtatccccatcactgtggttttctttttcagcacttccttcttttttggagatgcaagacattccagagtcatcttgtagatttcctgccccaatcttagaatcagccattactcgaagtagccttggcctcttttataagagaatggtattagaaaccaagacttgggtgctaggtgtgcttgttactactggagtgtcattgcatttatgccctctcagctgatagagaaagaaaatatatgtatgagtatataaatatgtataaatgcaaacctatgtatatgcattagcttgctagggttgctgtaacaacctattgtaaaaacacaatagattgggtggcttaaacaacagaaatttctcacaattctggagactggaagtctgagatcaaggtgttagcaagattgatttcttctgggggctttctccttggcttgcagatgttcaccttctctgtgtccttgcatggtttttcctgtgtgtgtgtctgtcctaatctcttcttcttacaaagacaccagccatgctggattagttcccacccacataacctc

SEQ ID NO: 588 - DNA, 20001 bp, Homo sapiens
ttcacaactagttattgatctattcaggaattcagcttcttcctggtttagtcttgggagggtgtatgtgtccaggaatttctccctttcttctagattttctagtttatttgcaaagagatgtttatagtatttctgatggtagtttgcatttctgtagggtcagtggtgatatcccctttatcattttttcattgtgtctatttgattcttctctcttttcttctttattagtctagctagcagtctatctattttttcaaaaaaccagctcgtggattcatttattttttgtggagtgtttgttgtgtctctatctccttcaattctgctctgatcttagttatttctgtcttctgctagcttttggattagtttgtccttacctctctggctctttcttttttttaagtggaatcttgctctgtagcccaggctggagtgcagtggcatgatcttggctcactgcaacctctgcctcctgggttcaagcaattatcctgcctcagcctcctgagtatctgggattacatgcaccctccaccacgcctggctaatttttgtatttttagttgaaacagggtttcaccatattgagcaggctggtctcaaactcctgacctcaggtgatccacctgcctcagcctcccaaagcactgggattacaggcatgagccaccatgcccgcccctctagttcttttaattgtgatgttagggtgttgatttgagatctttctagctttccaatgtgggcatttagtgctataaatttccctcttaacactgctttagctgtgtcccagagattctagtatgttgtctctttgttctcattggtttcaaagaactttttgatttctgcctttgtttccttatttatccaggagtcattcaggagtagattgttcaatttccatgtagttgcatggttttgagtgggtttcttaatcctgagttctattttgattgcactgttgtctgagagactgttatgatttcagttgttttgcgtttgctgaggagtgttatacttccaattatgcagtcgattttagaataagtgccatgtggcactgaaaagaatgtacattctgttgatttggggtggagagttctgtagatgtctattaggtccacttgaaccagagctgagttctagtcctgaatatcattgttaatttcctgtctggatgatgtgtctaatattgacagtcaggtgttaaagtttcccactattgtgtgggagtctaagtctctttgtaggtctctaagaacttgttttatgaatctgggtgctcccgtgttgggtgcagatatatttagaatagttagctcttcttgtttaattgttccctttaccattatgtaatgcccttctttgtcttttttggtctttgttggtgtaaagtctgtcttgtcagagactaggattgcaacccctactttttttttgctttccatttgcttggtaaattgtcctccatccctttattttgagcctatgtgtgtctttgcatgtgagatgggtctcctgaatacagcacattgatgggtcttgactctttttttttttttttttttgagacggagtctcgctctgttacccaggctggagtgcagtggcaccatcttggctcactgcaagctccacctcccgggttcatgccattctcctgcctcagcctcccgagtagctgggactacaggtggccaccaccatgcccggctaatttttttgtatttttagtagagacagggtttcactgtgttagccaggatggtctcgatctcctgaccttgtgatccgcccatctaggcctcccaaagtgctgggattacaggtgtgagccatcatgcccggccgggtcttgactcttaatccaatttgccagtctgtgtcttttaattggggcatttagcccatttacatttaaggttagtattgttatgtgtgaatttggtcctgtcatcacgatgctgctggttattttgcacactagttgatgcagtttcttcatagtgtcattggtctttatattttgctgtgtttttgcagtggctgatactggtttttcctttccctattcagtgcttctttcaggagctcttgaaaggcaggccttgtggtaacaaaattcctccacatttgcttgtctggaaagaattttatttctcctttgcttatgaagcttagtttggctggatatgcaattctgggttgaaaattcttttctttaagtgttgaatattggccctcagtctcttctggcttgtagagtttctggtaagaggtccactgttagtctgaggggcttccctttgtaggtgacctggcctttctctctggctgcccttaatattttttccttcatttcaaccttggagaatctgatgattatgtgtcttggagttgatcttctcatggagtatcttagtggtgttctctgtatttcctgaatttgcatgtcggcctgtcttgctaggttggggaagttctcctgggtaatatcctgaaatgtgttttccagcttgtttccattctccctgtcttcttcaggtattccaatcaaatataggttcagtctttttatgaagtcacatatttcttggaggctttgttcaatccttttctttctttcatctctagtcttatctgcatgccttatttcagcaaggtagtcttcaaactctgatattgtttcttttgcttgtttagcttttgatacttgtgtatgcttcacaaagttctcgtgctgtgtttttcagctccatcaggacatttatgttcctctccaaactggttattctaattagtagctcctctaatctttaatcaaggttcttagcttctttgtattgggttagaacatgttcctttagctcagcgtagttttctattacccattttctgaagcctacttctgtcaatttgtccaattcatcctccgttcagttctgtgcccttgctggagcaacactgcaatcatttggaggagaagaggcagtctggccttttgggttttcaggtttttttgttgattctttctcatctttgagagtttgtctagttttgatctttgaggctgctgacccttggatggggttttttggaggctttttttgttgttgatgctgttgttgctttctgcttgtttttcctccaatggtcaggtcccttttctgtagggctgctgtggtttgctgggggttcacttcaggccctattcatctggtttgcttctgtgcctggagatgtcagtcaaggaggctggagaacagcaaaatgggtgtctgctccttctgggatctctgaccttgaggggcaccaacctgatgccagtgagatcgctcctgtataggatgtctgaaaacccctgtgggagggtctcaccctgttgggtggcccggggaacaggacctgtttaatgaagcactttgtctcttggtggagggggtgtgcctttccctgggaggaaacccactagtctgggctgcccggattcctcggaactaccaggagggaggggtggctgcaggttccccctacgggctcaggcccggagagatccaggttctgtccctgagcctgtggctggagttgttggagtttctgcagggaagccttgcccagtgaggaaggatgattcagggttaggcctgaagaggcactccggtcgcagtctgccatagctggtgtgttgggctgtggggacatgtcttgagacgaagccgtccagcttccctgtctccagcaggggaaaagcgcagcatggagctatagagatagatgctgcctttcccccacccagagagcttagggtgttaggcagttgtgagtcccagctctggctgttgcccctccctcaaggagctcaaatggcttagacagcaggcagctgtagctgtggtgctgctcgcccctgcccaccgggagctcagtaagcttaatcagattccagctgagaggctgttgagattctgcagggctctggggttggggcgctaggccctggaggtgtgggcttgcgagtgggatcttccgatccacgggttgcgcggttacatgaaaaagcatggtttctccagctgggtagcatgttcagttaccgcctgtcttggctccagggtgggggcttccctgccccgtgtggctctcaggtggatcaccataccacgctgctcttccttcctctctgtggaacacgccagtctcctagccagttctgaagagagaagctggatacctgctggaaataatgaaatcctcatcccagagggtcctgagccccaagttcctgtgcccctctcagtctgtggttgctattcttatgccttcctctgttactattaattgaaggaggggcctgtggatctcctcctgagtcgtaattttatttattttatgttattatctttttttttttttttttttgaaacagcgtctcactctgttgcgtgggctgtagtgtagtggcacgatcttggctcactgcgacctctgcttcccaggtttgcgattctcctgcctcagcctcccaagtagctgggtttacaagcatgtgcccccatgcctggctaatttttgtattttagtagagaaaagatttcaccatgttggccaggctcgtctcgaactgctgacttcaagtcatctgcctgccttggcttcccaaattgctgagattacaggcgtgagccaccgtgctcggccttatttttttatttattctttcacttttttgagtatcttacaatttttaatttcattttgttataatttttaaatttatgttttatttcaatagttttttaggagcaagtggtgtttgcttacatgagtaagttctttagtggttatttctgagattttggtgtacctatcactggagcagtgtacactgtacccagtgtgtagtcttttatctctcgcccccatcataccttttccccaaaatccccaaagtccattgtatcattcttatgcctttgtgacctcacagcttagctcccacttatgagtgagaacataggatgtatggttttccattcctgagttacttcaccaagagtaatagtctccaattccatccaggttgctgcaaatgccattattttgttctttttaagggctgactagtattccattatatatatatctatctcacattttctttattcacttgttaatttatgggcatttgggctggttccatatttttgcagttgcaaattgtgctgctataaacatacatgtgcaaatgtctttttcgtataatgacttcttttcctctgggtagatacccagtagtgggattgctggatcaaatggtagttttacttttagttctttaaggaatctccacactcttttccatagtggttgtactagtttacattcctactggcaatgtagaagtgcttccttttcaccacatcttgccaacatctattcttttttgattttttgattatattatggcctttcttgcaggagtaaggtattatcatgttgtggttttgatttgcattcccctgataactagtgatgttgagcatttttccatatgcttgttggccatttgtgtatcttcttttgagaattgtctattcatgtgcttagcccactttttgatgggattgcttgtttttttcttgctcatttgtttgagttctttgtagattttggatattagtcctttgttggatatacagattgtgaagattctttcccattctgtgggttgttaactttagtgattatttcttttgctttgcagaagctttttagtttaatttggttctacttgtaaatttttgtttttgttgcaattgcttttgaggacttagtcataaattctttgctaaggctgatgtccagaagggtatttcctcagttttcttctaggatttttatagttttacatcttagatttaaatctttaatccatgttgtgttaatttttatatatggagataggcagaggtccactttaattattctgcgtatgactagccaattatcccagcaccatttattgactagacagtccttttctccttgcttatttttgttgaatttgttgaagatcagatggttgtaggtgtgtagttttatttctgggctctctattctgttctattagtctatgtgtttgtttttgtactagtaccatgctgttttggttactctagccttgtagtatagtttcaagttaggtaatgtgatgcctttggctttgttcttttttgcttaggattgctttggctatttgagctcttttttggttccatatgaattttagaatagttcttctaattctctgaaatatcatatttgtagtttgataaggataacatcaaatctgtagattgctttgggcagtatggctatttttaactatattgattcttccactccatgagcatgaaatgtttcaccatttatttgcgtcatcggtgatttctttcagcagtcttttgtaatttttattgtagagatctttcacctccttggttagatgtattcctaggtattttatttcctgtggcaattataaatggaactgccttcttgatatggctctcagaattaccatgattggtgtatagaaatgccactgaatttgtgcattgattttgtgtcctgaaactttactgaagtcatttatcagttctaagagccttttgttagagtctttagggttttgtaggtataggatcgtatcatcagcaaagagagatgatttgacttcttcttttcctatttggatgccttttatttctttcttttgccccactataattttatatcctaaagacaatttgttttggaagtgtctttttaatttagtacattgcagaataccaagaaggagataaaagggctcccagtctcaagaagcttagttgtgcaattattaagacattcaaatttaaaacaatacaaagaaaaaatagtgaactgaaacaaaaagaagacaacctttggattcagcattcctagatttcccagcttctctatttagtagccataatctctgaaagtaacttaacctccgagcttcagttttcttatctataaaatggaaattttagcaataccaaatgtaggtaatgagggtcaggaggtaacatctaaatcatttattcatatgagagtttatataaaaattaatagcagaatatgggatacagacaaataatattctagaattatacaggaatgattacttatgctatagtggcttgacaggattttcaatttttagcagaattttgaaaagtgtggaataatgaaggagctagtccaattatggagaataatgtgaacaaaattttggagcattatttatctaatgtaataaaaaacgtaaccttgtccaaagtaggtttgtttagggagctgagcaagataagcctgacaaaatgaagacaatttgaatgcctggatggctgtctatttaaggagaaggatgaaaccaagatgagcttttaggctgtattatgcaggaattcttggacacgattcattcttagccccaaacatctgtttactgtccctatatttttgtcttttctagaatgtcatctaagtaaaatcatacactattagcctcttgaatctggcttctttcacttataattcatttgagtttcatttatatggtcgtatgtatcagtagtttgttcctttttattgctgaggaatattttattgtatggctgtatcacagtgtgtttatttaccagttgcaaacatttgggatgttgccaggttttggcaattatgaatcaacatttgtttaaaggtttttacatgaatattcaatcttcttttctcctgggtgactgcttagaaatgggattgctgggtcatatggtatgcttatttttataagaaatggtcatactgtttttcaaagcgactataatattttgcattctcttcagcaatgtatgagaattcatccatatgtcattttatttgcttgttttaaaaaatgaacttcattttttagaacagttttatgtttacagaaaaattgccaagatagtaaaaagaactcatatgccccacactgaatttctcctgctgtgaacaacttactattacattatataattgtcacaattcatgaagcaatatttattccagcactgaaccaacatttttccaatattgagtatattttaatactgaactgacattattattattaatggaagtccatcctttattcagatttccttagttttaacctaatgttcttttattgttcctggatgccatccaggatcccacattacacttagtcaccatatctctttaggttgctcttggctatgacagtttttcagactttctttgtttttgatgactttgactgctttgaggattatggtcaagtattttgtagaatatccctccattgggatttgtctgatgtttttctcattgttacgctggggttatgggttttggggaggaaaaccacagaggtaaaggggctatttttgtgtcataacaagggtacctattatgatttaggcataatttaccactgttcatgttgactgtgaccacttggcagaggtagtgtgtgtcacattcctccattctaaagttaccttttgcctccccttaactctatatgtgattcttttttaaaaatatttttaattcacaaataataagtatatatatttatggggtaaattgtgatgtgatattttgatatatgcatacaaagtggaataattaaattaatctaattaacatatcattacttcacttatctgtttttgtggtgagatatttgaaatgtactctcttagcaattttgaaatatacaatgcattaactatagtcactatgctgtgcaatagattgcaaaaacttattcctcttgtctaactgaaactttttctttgaccaacatctttccactccctccctccctccatcagtctccagttaccacaatgctactgtctacttctataagttcaacttttttagtttccacatataattgagaccatgaggtgtttgtctttttgtgcctgtgcctggcttatttcacttagcagaatgtattccaagtttatccatgttgttgaaaatgacagaattttcttttttttaaaaaaaggctggctagtatttcactggcatgtttaaaaaaatacatgtatccattggtgaatgcttaagtttattccatgtcttggccattgtgaataacgattcaataaacatggaagtggaggtttctcttcaacatattgattttatttcctttggatatgtattgagaagtgggattgctgggtcacatggaagttctatttttagttttttgaggaatcttcatactgttttccataatggctgtactgttttacattcccaccaacagtgcacaagagttacctttcctttacattcttatcaacgcttatctttcatcttttttttttttataatagccattctaacaggtataaggtaatattgcattgtggcttccattttcattttcttaatgattagtgatgtcaagcatttattcatgaacctgttagctgtttgtaagtcttcttcttctttttttttttttttcttaaaatcgctggcttttatgacgatgtcttctaagagctcattagaatctataagatagcaggaattttgccaacaagggctgcatagaaaccacaggggcaactcggccagggctgctcccattgcggtggccaagaactggctgagggcacgacactggactcttgggataaacactttactctgggtgaaggctgcatatttaaggacacaactgcacatttagatcaagcagtggtgatctcagggcatacacggagcttcatgctgagaacacccaggggtcctctagagtcttcctcctcgtctttaatttcagaaattctgtctacagatttaaggatttcggcagcaagattcagtatctcagctctggaaaccagttgcttaatggaagcctgtgcgctgttcatgaccacccagaggttctgcaaggccacgtcggcgttctgcttcaccactgtcaggctggccccctggtcgcaccgcaaggcttcattctctcgctggaagctggagacctgcgcctgcagcaaactgatttcctgtttcagtttcacgacatggttttctgcctttacagcccgtttggtcatcagctccaggttctgctccacctgctgaaccaccaactccaagtcgtggtagtcgctttcctcgttgatcatttttgcttctaatttccgcacaagcgtcctcaccatttctgtttgagcttcagagaagctctgaatctcattcagctttcttctcagcttagaattttcacctttcagtgcttcgtaacttatctgcagcgtccgcaggtgcctgtctcccagagactctccctgagccgcaaaatcggtgctaggactccctgccggagaggccggagacacgcgagaatcagtgtcactcaacgcccacgggagcagagactcgggccctgccagctctgacggggtggagaaaaaggaaaggtatgtgctgcagggcgacgtgcaggcagggaccctctccgggtgagtctgctggatggcggacggcaggtaggccccactccatccggtgtcctcatcctcctcctcatccaggaggtcaccggcccctgtcgggtcctcgaaaaatggctgccgatactccaggccataccccccggtttgggagagtggggagttgtggtcaagtcccagtgaatgcctcgacgcttcctttgcataaattctgctgaccgggtcctcttttgacaggccgatgttcttggtcttcagaaactctttaaaggagaatggatttgcctcttcaagatcttcaaatttgtcatctccaaaatgtgtctcgtgggctcctgacgggctctgcttagaacatttcccctttccatagcccaaatcgtcgggaatggcgaggctccgggctcgggacagcggggtgacgccccggcggcgcgggtagctcgacatcgccgtgggccaggcggggcaggcggggcaggacctgcctagcccggcagcggcggctcaatggcccctgctctgcccgtgccgcggcccgtgtcaaccgcccccgtcgcccgccgctcggccgcccccgatcctccgaacctctcgtaagtcttttgaccaatgtctattcaggtcctttgcccatttttaaagcaggttatttgtttttttgctattgagtttagttcctcatatgttgtgttaggccattcttatatcactctaaagaaatacctgaggctaggtaatttattaaaaaaaaaaaaaataagaggtttaattggtttatggtcctgcgggctgtacggaaaacgtggtgttggcatctccttccggtgagggcctcagggagcttacaatcttggtggaaggtgatgggaagccagcatgtcacatggtgacagtaggagcaagagagaaggggggaggtgccatactctttttaacaaccagatcttgcctgaacttagagtgagaactctctcattaccaagggaatagaactaagccattcatgaggatccatcctcatgatccaaacacttcccaccaggccctacctccactactagggattacatttcaacatgagatttggagcaaacatccaaaccatattatatgttttggatagtaaccccttatcagatgtatggtttgcaaatattttctcctatgccatgtattgtctcttcactctgctatttgtttcctttgctgtgcaggagctttttagagtgatgcagtcctatttgtctctttttgcttttgttgcatatacttttggggttatattcaaaatattgtccagaccaatgtcatggagcttttcccttatgttttcttttagtagtttaactactaaaataaagtttcagtagtttagtgaaactactaggtttcaggtcttaatttgtctttaatccagtttgagttgatttttgtatatggtgaaaataaggatccaatttcattcatctacatttggatatccaattttccccacaccatttattgaaaaagctgtcctttcctcattgtctcttcttggcacctttattaaaactcagttttccataaatatttggggttatttctgaactctatcctgtttgactggttttgtgtctgtttttatggcagtactgtgctgttttgattactataactttgtaatatattttgcagttaggtactatgatgcctccagcttttttctttttggtcaagataggtttggctattcagggtcttttgtgtttccatacaaattttaggattgttttttctatttctttaaagaatgacgttggaattttgacagggattacactgaatctgtagattgctttggatattatggatatcctaacagtattaattctttcaattcataatcatgcctttccatttacttctgttttcttcagttcctttcatcaatgctttatagttatcaatatatagatcttcacttccatggttaaatttatacctaggtattttattttatttttttgctattgttaatgagattgttttattaatttcttgttcagatagtttgttgttagtgttgaaatgctaccgatttttgtatgttgattttgtattcttcaaattaactgaatttgtcagttataatgtttttatttggtaaagtctttaaggttttctatatgtaagatcatgccatctgtaaacagggacaatttaactacctccttccaatttggatgttttttcatttctttttcttgccaaattgcacaggcttggacttccagtaaaatgttgaaaagaagtagtgagattaagcattcctgtcttgttctagatcttagaggaaatgctttaaacttttcactgttacaaatattagccgtggacttgccatttaaggactttattgtgttgtggtacatttcttctctaccgaatttgttgagagtttttattatgaaacgaatttgaatttcatcaaattctttttctatatctactgagatgatcatataatttttgttcttcattctattaataaaatcagaaacaaaagaggagacattacaactgatagcacagaaatacaaagggtccttcgggaagccgaggcaggcggatgacctgagatcaggagtttgagaccagcctggccatcatggtgaaaccccgtctcttctggaaactacaaaaattagccaggtgtggtggcaggcacctgtaatcccagctactcaggaggctgaggcaggagaatcgcttgaacccaggaggcggaggcggaagttgaagtgagccaagatcgtgtcattgcagtccagcctgggtgacagagcaaaactctgtctccaaaaaaaaaaaaaaaaaaaaaaaaaagaaatacaaagggtcacaagaaactaccatgagcaattataccccaataaattggataacttaaaagaaatgggtaaattcctagacacatataacctgccaagactgaatcatgaagaaatagaaaatctgaatagaccaataatagataagtagattcaatcagtaagaaaaagtctcccattaggctgaggcaggagaatggcgtcaacatgggaggcagaggttgcagtgagccgagatcacaccactgcactccagcctgggcgacagagcgagtctccgtctcaaaaaaaaaaaaaaaaaaaaaaaaaagtctcccattaaagaaaagctcaggactgattggcttcacagatgaattctaccaaacatttaaaaaagtactaatgctaatccttttcaaactcttcaaaaaaaattgaagagaaaggaatattttcaaattcattttatgaggccagcattaccctgatactaaaactggacacagacactacaagaaaagaaagttacaggccaaagtccccgatgaacatagatgcaaaaatactcaacaaaatactggcaatgcgaattcaatagcacattaaaaagatcattcactatggtcaaatgggatttatccctgggattcaaaactattgcaacatatgcagatcaataaatgtgatactctatatgtggttttgatttcacccccccccttctcaattattttctctgtcctataccataagtgtttttttctatatagtcttactatcagccttgaatcatgcttcagaaaaattatcaatctttttgcttttaaagcttatcgatttgttctaattcaagaaacttaaaaaacaatggaatttgggtgattctgagtgaattgattggggtggggcacaggcatcagtatcttttaaacagtcctcacatttgccttcccactgggtacccccttacctgatgaaatcctgtttaccctccagggctcacctgcatatcatttcctcaaggacatcttcctgaagagtttgatctaaatcaggtgctctcatagctccctgtttcctttctttctttttttttattttctaataagactagatttattcaataccctagtaaaagttttgattataagtatccaacagtataaaaagtacaaaacagatctgtagatttctaatatattaatacaaagtgcatgactacatacagtacatcctacaggcaaagagaggtggaaggggaaaaagaagactgtggttgaggtctagtaataaataaataaatacagaagtagagatgatccatattatagtatattctaccaccaatactgcagccaaaatgtacaaaaaaatcatttcaaaataactcaggaggatgataatggctggacttttgtaattcgcctcaaagactgtgggagaagccaactcaactcgctgtatagtctgtgcatatggtggcttgtagcatgtaggttttttccaaaagaaggaaatataaaatgtttagattaagaactataaaactacagggtgcctataaaaggtggcttactccttattgttattatactatccaatttttaaaatgcagtttaaaaaatgagcactgagtcttgttattacaaggcaggcaaatgtttctccctcattctgaaaagaccgaactggcgatgcttttcctgaacatttagaaaagaggcagtaagagtactctggtttaggttcaagtgagaggcttttcatgaaaatcttaggattgaagagctctaagttcaggatatctcaatgttcagaaagcctgactaaaagaagccaaaccaaaaccatttaatgtgaacacaaacctcttttcttttagtaagttttacttttaatacagagtgaaagaaaataaaaacttaataggctaaaacaagtcaaacacccattctacacagataaaaaccttcacaaaggtcaactgaagtaatccagagctgaaactgaattgtaaagattttcaatgaagtcacagaacacaaacaaaagtcgattatatttacacactcagcaagccctctaagaaatgtgccccaagaagcattaacctttgttttgtgccatcctgaggacttgtacattttatttttcagatagcttaacatttttaatcgagtgtgttctctaccatgcggtaatgctttggtactattcatacagggtctcgcctgtcctaaagacttgccatttccccaagaggagctttgattctgctttagaagttttacaaaaattaaaatctttatcaaatattaatatgaagggaggcacaggatgcaacatatatagtcaagttacctctctgtatatttagaagttactttctcctccaaggtatttgcaacagaaagctcagtctgtcctgcttaataatcagtagtacaggtttgaatcatcacaagcttggcaagaccttaatatttcaaaatcattaacaactacctctaggggcaagttcatgttactgagttatgacaaatttattatcatgagggaaaacaagtagccagccatcttaaaaatgccccaaccactgcatctcaatacagaaagactaaaaactacatacagtttatcatacaacaaatcccatctctgtcccctgaaattcccctagtttcattcattagaaggggattaaaaaaaaaaaagacttaaagagtactttacagcagcattcatctttcctatgaaatactcagcatcttaaatattatgtaccactctttttttagtaagctggacactggcttcagagtttgtgggactaggggatatcaacccattcaaaactactgtagaaattgtcttttggcagaatagcaggtatccaagttaaaaataagagggtcatttgagaccagcctggccaatgtggtgaaaccccgtctctactaaaactaaaatattagccgggtctggtggcgggcacatataaacccagctacttgggaggctaaggcaggagaatcacttgaacccgggagacggaagttgcagtgagccaagatcacgccactgcactcctgcctgggtaacaagagcaaaactccgtctcaaaaaaaaaaaaaaaaaaaaaaaaaaagagggtcagtttgctgctttgtggtcttttcaaaattcagattttttttgttccccttctacataaaaacctcagtcaccactcctgagtggagatgggcagaggctctggcccctgctcctctggcttctcggcagctgctttcttattgctgcagcaaggcttgaagggatgtgtgtcaatgaggacttccccaaaacggcctttatagttgatcccacaacatatcttctgtcttttccagtatgtgagatctaaaaaggaaaaaactggtgttctgttagaaccagaagccatctctgtatctgagccgtcatctgactggttactgtaacgaggagatggagctggggaggcacttgaggtggtattgtgagcatcagaattatgacgtttaaattccttctgcagtttactgatctggttgctttttatcctgttcccagatagagttttcactttctttggtttcaatgtagtctttagactgggtccaacccttgcatctaccacatgattccagtttttttttttgatcctgctggcaacttcttccatcttttcacaagcaggacacaggcattgcagatgtctcctgaacgagtctcatgcaatccaaaacagctctggaagtccttttcatagcgtttactgtcagtgaatcgagaactggaggacttagctctgcaaatacagtagccctctatacttcggtacatctttggcttgtgaaaaacaaacatcttttcttctgggtaatagtcttccgtaaatcgcgcttccccctccggcactccggtgactgctgagagagacgccgagccagcaaataagaatgctccctggtggatttgttggtaaataagacatctcgcgtcgggggcagctcgccggggcgagggcgaggacagcaggaggtgaaccgcgtcgctggccgccgcctccctcacctgcctgtttccattcttagagcgttgatcatatctctaattcagagtttctttattattattattattatactttaagttttagggtacatgtgcacaatgtgcaggttagttacatacgtatacatgtgccatgctggtgcgctgcacccactaacttgtcatctagcattaggtatatctcccaatgctatccctccccgctgcccccaccccacaacagtccccagagtgtgatgttccccttcctatgtccatgtgttttcattgttcaattcccacctatgagtgagaatatgcggtgtttcgttttttgttcttgcgatagtttactgagaatgatgatttccaatttcatccatgtccctacaaaggacgtgaactcatcattttttatggctgcatagtattccatggtgtatatgtgccacattttcttaatccagtctaccattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctggttctagatccctgaggaatcgccacactgacttccacagtggttgaactagtttacactgttggtgggactgtaaactagttctaattcagagtttctaaccctctgcaccactgacattttgggctggatataactgtgttctggtggtctgtcctgtgccttgtgggatgttttgcagcatccctggactctgcccactggatgccagaagcacctcatccccagatatggcaactgaaactgtctccaaacatcgccaaatggccccaggagggaacctctatccctcactccattagaaccactgctctaacacatggttattttatatgtagtctgtctcccccccatactataaactccagcagggtgcttgctttggcaatacatatatacccaaattggaatgatacagagattagcatggcccctgtgcaaggatgacacacacttgtgcagcattctactaaaaaaaaactgcaaaaccatcagaagagctttcttctctcctagattcccaaggacataccccaatgcctaggcacatcccagatggtggacaagaatttgttgaataaatgaatgactgagatggctaagccaggatttcacagctctaatgacggtgaagaccacaggtgtcaacagcagagaagaaaaggaaggaatacatctgagccacatttagagagcagaaattaaattttatgggaacacagtcacttccattcatttgcatataatctacggctgctttttgtgctacagaaggcagagctgagtagttgcaacagagaccacatgactcatgaagctttaaatatttactttttgacccttcacaaaaagagtttgtagaccccctttttagagattgtgtttagaatataaatcctaagtaaactattatgaaagtagctaaatgattttaattatttgcaaaacagatttctatttttacacattttaccattgccctatttctcacacacatgagaaatttgcatgcacaaacatgcattgcagagacgttctttcctgataaatagtttatcctgttactggatttttttttttgaggggttttgaatgccttccactcctcttttcctagaatgtcagaacttctttttttaaaaaatttcaatcttctagttttctaaagattttgttgggaacaagggaaaattaagaaaaagggtctcagtcctctgtgtaaaaaactattttttttacagcttttgtcatgctaaagacacaaatctgtttattttgtggttgctgacggaatatataaattctgtcttgaagattgtgtgaagctttcatagttcattcgctgattcattcaacaagcattaagaaatgccttctgagcactgggccctgcggatgcagagatgcataaaatgcattctttgccggtaacctaccagcagcaacagactggaagcaattacctggaagacagccttgtttgtgctaaaataaagtgaaaatgggagtgcagggaagttccaaccaaggctgctttacagaatggaaggaagcataggttttgtatcttaaattatacttttacttgttattaatagatcctaaggtgccagtatcgttggttagaaaaagttttacccccaaatctaaaactcaaatgtagcatcaactataagaatcatgtttaattattttccaccagtcctctccctattagcatgaaatataagaatcaagttggccgggcgcagtggctcacgcctgtaatcccagcaaattagccgggcgtggtgacggggtgcctgtagtcccagctactc

SEQ ID NO: 589 - DNA, 20001 bp, Homo sapiens
cgcccaaagtgctgggattacaggtgtgagccaccacgcctggccctgtgtatgtatatgtgtatatatgtgtatatatatacatacacatatatatacacatttcagagagtgatatccctgccataaagcaggcccagttaagttataatttcaaagagaacctaaatcctttggccaccagctcaagaagccatggagaaactcgtggcggcattttcttagaggaataccatctaccaagagcagatggaaaagggtctgccaatgtgttttgtcttgtttttgcttccttgtagagcgtctgttggctctgtttgttgggaaattttaacaagctcagcctgcagaggcctaatatcaatttccgggaggtttcatttccaaagtgtctccaaggagaactcaaaaggggcagaaaactttgaagctgcacccctacccccttctccctggggatctggcatcctctgcctggaataggtggccagttgcataacacctgctgtgcgtggcgttcttgtgccagctgatcacttgggcatccttctgcagagggctgtggacaccttgcctggggcacactcagaccctgagatcggattatgtgggggtgataataacagcagttcctgtttattgcttatctcgtgtccccaccccctgtcctaaggacctcacgtattaactcatttaatccctgcaactaccaccatccgagatgggtatagtgatcagccccatttcacacaggaggagactgaggttcagagaggcaaagttacccagagttacccagctggaaaacagctgagctgggctctctggtgttcaaagctttaatggggcagcttggtacagtggcttacgcctgtaatcctagcactttgggaggctgaggaaggaagatcgcttgagcccaggagtttgagatcagtctggggaacatagtgagaccccatctctaaaaaaaaaaaaaaaaaaaaaaaattagctgggcgtagttgcacgagactgttgttccagttacttgggaggctgaggtgggaagatcatttgagtccaggagtttgaggctacagtgagctatgattgtgccactgcactccagcctgggtaacagagcaagactgtttttttttaaaaaaaccaacttgggcccattgggggtaccgtaagaattagagtgctaagtaattaaccactccctacccccatgcaggataaactgtggagctcaaaagtccagcatctctcttcctgttccttttggggagcaggttgtcatggtgacagatgcaggtggaattaggatgcgaacagcagagataagaattctagagtggagcaggtcttggcaaaagttccctttgcaagcagataggcctgggagaaggcactgcctggttgcaagggagaggcagaagctctgtcctccatagatttttactgacagtctgggaaagttccaccctcattttgtccaccctgcagggccactgggctcggccacctggtatgggggatctggggccagcagccattgaattatatgaaatagaatgtgcgtcagtccacttttcactggagtgagccactgaaagacagatgaaggtaggaatgaggagaagacaaagtgaataaaaaggaaaaaaatatgatcggcctggcaaggtagctcgctcctgtaatcccagcactttgggaggctgaggtgggaggatcgcttgaacccaggagttggagaccagccttggcaatgtggcaaaaccctgtgtctacaaaaaatacaaaagattagctaggcatggtcatgcacacctgtagtcccagctgctcgggaggctgaggtgggagaatcacctgagctcaggaagtcaaggctgcagtgagccatgattgtaccactgtactccggggcctggatgacaaagcgagaccatgtctcaaaaaaaaaaaattatcaatatgctggagaatgaaaaacacagggtacgtttgcaaaaagcctcaaggaatgactgaagaagaggaaaaatgtacaaggcagacctccgaaggccactggctttgtcacaacagagaacgaaaatgtctttttattattttatattctcaaataaagttttatctttgccactttttttaaagcagatgaatgactgatcttgaatttttttctcttaaagtgcatgaatcttcatgaacttttatttccaaagagccttagaacctctttatcagccaaatgaataatgtctctcccggccagattgtttgatgtgtctattaataatggaattagcagtactcccctggttcagaatgggggtctggccagctgaggctatgggggtgaaagtggggagatagtttcttcctctgaagaagagagggagcaggaaccatctgtgggatttgggcaagctgggtccttattgctttttatgtttattgatgagagtattactaacagtattagctgacacttcctgagtgcttactattactgctaaaaatagcattcattgagtacttaataatattcatattaataatagctaacatggccaggcatggtgtctcatgtctgtaaatccagcactttgggaggccaaagtgggagaatttcttgaggccaggagtttgacaccagcctgggcaacatagtgagaccccaaaatgctacaaaaaattgctaacatttattgagctcttggtataagccaggaaccactcaaagcattttacacgtactaactcagttaaatcttttttttttttttttttttttttgagatggagtctcgctctgtctccccggctggagtgcagtggtgcgatctcggctcactgcaagctccgcctcccgggttttacaccattctcctacctcagcctcccgagtagctgggactacaggcgtgcaccacctacgcccggctaattttttttttttttggtatttttagtagagatggggtttcaccatattagccaggatggtcttgaactcatgaccttgtgatccgctcacctcggcctcccaaagtgctgggattacaggcatgagccaccgcgcccggctcagttaaatcttatacccagagaaggaggtagctactattcttatcttcattttatagatgaggaaatggaggcccagagaggagtgaaattctgaaagtcacacagcctggaagtgatagggcaggaatgtgactgcctgccccaaagtccttgcctttcacaaccaggctttgctgctcttgtagtttccaatgtttactgttgtctttcaaaaactcttcctggcatattgttagggagagacattttgtccctgtcactctgcctccttcaataacagtagatctgttaataaggctgataataacagtaatattagtaataatagcaagagtaattaataatcattggtctttcttttttttttagacatgaggtcttgctcatctctaaaatgagcaatgctactgcaatccaacctgggcaacagagcaagaccctgcctcaaaaaaaaaaaaaaaacaaacaaaaccctaaataaaccaacaaactaaaggcacagataattataagcaagatttttcacctgtgtgaggagcactagaaagtcatgaagaggaaaggataattcttttccatatgagactgtcttgtacatggtagggtatttagtatactggcctcccattctctaaatgctcaggctggtctcgaactcctgggctcaagcaatcctttgcctcagcctcctgagtagctgggattacaggtgcataccactgtacctggctttttttttttttttttttttttgagacagagtcttgttctgttgcccaggctggagtgcagtggtgtgatctcagctcactgtaacctctgcctcgcaggacaattcttgtgcctcagcctcctgagtagctgggattataggcgtccaccaccacgcctggctaattttttgtatttttagtagagacagggttttgccatgttggccaagctggttctgaacccctgacctcaggtgatccacctgtctctgcctcccaaagtgctgggattacaggcgtgaaccatcacactggcctgtacctggctcttcattggtctttactatacagagagtgctgtggtaaacactttattccacctaaactcccgttttgatctctcattcccctgagtgactgacagccccagagtctcatcaatgcaccttcaatttctttgtcactttctcgtcactagtcatgtcctgcaaactggcctccttctggtccaccccagggcctttgcacatgctgttgttagactgaaacactctactcccttctcagattgctcctctggaaacctgccctgagaccctgggagcagtttcttggtcgtatttctcagaatgtctcagaccacttcacttgcagttgtgtgactgaactcacagcatgagcttagaatatagtaggcacttagtaaatactaactgaatgaatgcataaacccataggagaagattgaagcgaaagaatgacctagaacaatggttttcagaaaactgttgtagaactacgtggaaacctaataacataatgattgaggggcactgcaggcacttagagaatggtaggcagttatactaaataccctaccatgtacatgacagtcccatatgggaaagacttatcttttcctcttcatgactttctaatgtccctcaaagaggtgaaaaatcttgcttgtaattacctgtgcttttagtttgcttgtttgtttgggttttttctttctttctttcttttttttttttttgagacaaggacttgttctgttgcccaggttggaatgcaatggcataatcatagctcactgtaatcttgaactcctgggctcaagcaatcctcctgcttcagccttccaagtagctagaactacaggcacctgccgccacacctggctaattaaaaaacttcttttgtagagatcgaggtctccttatgtcgcccaggttggtctcgaactcctggcctcaagcgattctccttcctcagcctcccaatgcactgggattacaggtgggagccactgcacctgatcctgtgcttttagtttaaacctaactcttttacataagaacacaacatattttttgtatgtttttaatatacattgcattttcctgcaatgcaactattaaataaatggaagaaagactagactcttttgtatatggaactttgccaagaggtgttcaacattgtggaacatcttgacactgctggcaactcccctcatgtggtttgaattgtccacacaacccagagttagccatcatttgtgcctgtcacttcatggtgattttgtgtatggtgtacatatcagaattacttcactatgtcctccagagtctcattactcaaaatgtggtccctggaccagtagtatcagcctcatctgggagctcgttgcaaatgcagaatctcaggctccactgagtccttagccctacggaattacaatttgtgttttaacaagatccctggggattcacatacacattagattttgagaagtgctggcctacctcatatgtcatacaacaggatcacttaaacccatcattaaaaaaatcaatattatgccctgatggtaatataaaagaggactaagagcaggttaatttgtaataggacaatgtctacgatgtctattttaatgggtaagttgttgagtccctatatgcagaatcactatagcatctgctagaaagtattacaaaatgtcgttatgaaaaagaggatgctggttctgaatggataagttgctggcctggaagatgcctcaaaagctttctaacatttttatttatttttaaaaggtgaggtctcactatgttgcgcaggctggtcttgaactccggggctcaagtggatcctcccaccttggcctcccaaagtgctgggactacaggcatgagccaccacatcccgctgcatccaaagctttgaaactctgctctcccttcaattctaacggcccaaagtgccttttctttttctttattttttattttattttttgagacaaagccttgctctgtcgcccaggctgaagtgcagtggtgcaatcatagctcatcatagcctagacatcctgggctccagtgaccctcctgcctcagcctcccaagtagttgggactgcaggtgcatgccaccacatctgtttaattttttatattttatagagatggggtctgcctctattgcccagactggtctccaactcctggtatcaagtgatcctcccaccttggcctcccaacagagtggcttttcaaacttccaaagaatagcattaggtaaatagagttggctgaaaatggccaaaaatgctctaaatttaccgagcacttattatgtgtcagctgctcttccaggccctttgcatacattacctcattcaatcctggcaatgacccaattagatcccactatttccattgtgtgaggcccagagatatgaagtcactttgcaaaagtcacacagcaagaacacagaagactatataattctggacgacagtggggcttctcttaatagtttccctgaaatgctcaaggcctctggtgccagagagcctgggttcaaggacactggttagaggaatgaccttgaggagctcactcaatctctcagtttccccatctgtgaagcctctaatccgaacactttgggagactgaggtgggatgattgcttgaggccaggagttggggaccagcctgggcaacagagccaggcctcatttctactaaaggtaaaaaaattaggctgagtgtggtggctcaaccctgtagtcccagcactttagggaggctaaggcaggcggaatgcttgagttcaggagtttgagaccagcctgggaaacacagtgaaaccctgtctctacaaaacactgtctctacaaaaattagccaggcatgtggcacatgtctgtggtcccagctacttgtgaggctgaggcggatggcttgagcccgggaggtagaggctgcactgagctatgactgccactgcactccagcctgggcaacaggcgagaccctgtgtcaaaaaaacaaaaacatacagcatttttttttttttgagacagagtcttgctctgttgcccaggctggagtgtgatggcacgatctcagctcactgcaacctacctccacctcccaggttcaactgattctcccgcctcagcctcctgagtagtgggaatacaggtgggcaccaccactaatttttgtatttttagtagagacggggtttcactatgttggccagcctgttctccaactcctgacctcaagtgatccgcccgcctcggcctctcaaagtgctgggattacaggcatgagccactgctcctggccaaatacagcactttttttttttttttgagacagagtctcactctgtcgcccaggctggagtgcggtggtgtgatctcggctcattgcaacctccgccccctgttttcaggcgattctcctgcctcagcctcctgagtagctggggctacaggcgcctgccaccgtgcccggctaatttttgtatttttattagaggtggggtttcaccatcttggccaggctggtcttgaactcctgacctcgtgatccatccgcctcggcctcccaaagtgctgggattacaggcgtgagccactgcgcctggccaaatacagcattttataatatatttttataaacaaatacacagcacgtgctactttggctgttgtcattattaatgttaccgtcattctgcggattcgaggtcacctccacttacttcctcctccgatgcctccgctccttgtcctccctccgcgcgtccccctcgtacgtggctggagcgccatgccggtgccttctcctgcgctcgcccccgtcggggccctcgccctcgccctcgccgccccgggccggccggctgccctcgcggtgccgcgccctccgctccgccttgtcctccggaccctcctccccgggcctgcggtgcgcgcgatgacgtcgatgctccccgtccgcgcccgtgcgcggggacccgctgcggctctccctgctgcccccctgccggtgcacgtgcctccggtgggggtccccggccttgcctcgctcggcctcgccctcccagaacccgggttgctccaggctgccctcccgggcgtggtggtccgactcgcggccgtagggtccctcccggctcagctcggcctcctggcttcccgcccagggcctccgtgcgtccaggcccgccgagccgctggggtcccgggcccgatcgtggtagcgggcctgtttcctgaggaagtcctcggcgcgctgctggccgaggcgctggtccacggtgggctcggccgcccggctcttgttggtgttgttgttgcggttctcctgcgggtccaccaccagcggccggtccaagtgcgtcttcatgtctggccgcaggtgccgcgtgtaggcagccttccagcgctcgtccgggtccatttcgttatacagggcctcccggctggccagcaagttctgctttcgcatctcactggtccgctgctcccacacggacttggctggcttttgattcttctgttgctctttcctgcagtggcatggtcacaggacttagagcattgctaggcactgtagcttggatggatgacccaggcgaaccaacccacatctcagcctcccactcctgctctccaccctctactccccactgaatgctaggagtctgtgagcatctgagtcaggtcccagcctcctctgctcaagaaccctccatggctcccacctggctaggggcaaaagcccaagtcctcccccctgacccagaaggccctgtgtaatctgcttgtcacctccttgccttcacctcctcacacttactattcgattctagtcacacaggcctccttcacatcaggcatgttcctgcctcagggccattgcctatgctgttccctctgcctgggatgcccttccccaggccccccagtggctcctccctcacctccttcaggccatgtaaccttctaggtgagcagtccccaacctttttggcaccaggggccagttttgtggaagacagtttttccacagacctaggtgtggggggtggttttgggatgaaactgtttcacctgagatcatcaggcattcgattcttaaaaggagcacgcaacctagatccctcagatgcaccgttcacaatagtgtttgtgttcctatgagaatctaatgctgcctgctgatctgacggcaggtggagctcaggcggtaatgcttgcttgctcactgttcacctcctgctgtgcagccccgttcctaataggcctcggcctggtaccagtccacagccccgggactggggacccctattctaggtgatgccttccctgacaacttcgtttaaaatcacaactctcttcactcccagcatttgctatttccctcccctactttctctgtagttccatcgccttctaacacaatatataatttacttatttatctaatttattgactccttcccttgctagaatggctacacacaggtgggattttttttttcctccttgttaatgctgtatccccagaagttagaacagtgctgggtacataacagctgctaaccaaatatttattgagtgaaagtgggtggaaggacaagaagtgtctcttcctaaagctcagttctgtcaaggaccacccccactgcttcccaaatctgtgcctgggatagtgtggacgttcaggagccagggtagcatcccagggattaggggcacttacacagctatagacatgttggccgcggacagaggactcacttctgccacctccttggctttctgtagggcaagtttctggttcgctgcttcttcttcctcttgctcgtcctaaaaggcacgtggaatctttgttcacaaaacatgaactaggccttggggactcacttctgaccctgttgctgaccaggggcaacatttgaaatatttcgaccaatcagaaccaaggctccccaattggaatgggtacctgctattggttaagtgtattgctatcccctctgtgtataagtttgacatctaactcattatgaagcctattttaacacacagccagataacaaaaaataaaaatgtcccttctcttcctacaatgaagactttcctgcagcctatttttttttcttttgtttgttttcagagacagagtctcccttggttgcccagcctggagtgcagtggcacaatcatagctcactgtaaccttgaactcctgggctcaagcaatcctcccacctcagcctcccaagcaactgggactacaggtgcatgccactatgcctgtatacatttaattttttttttttttttgtagagacagggtctcactatgttgcccaggctggtcttgaacttctggcctcaaatgatcctcccatttcggcctcccaaagtgctgggattccaggcatgtgccaccatgcctggcccctgcatcctgtcttaatgagctggaaagcagtgcaaagattttcctctcactaggctttctgagccatgtgaactctctgaaccaactttcaaaaaacaccaactaccctcacacacagaagagcctggcatccgatggcccctgccatgcactgtcaacagcccccagaaggagaatgaggagaggaatttatattcccagcccccatgacaggaaggcggtggggagaggagagcagggcacttgggctacagccaactgcccagggtgctgctgctcactggtggttaggttcagagaggaggagaatgggggaagaggttttaaaaatacatacagaaaaagacgtttttggactttaaatccttcttcagccttcatgcagggcctcattcgtaaaacagaaaagccaacaaagaaaaagcaaagaaaaggcaacgagaaagaaatggccagaaatgaacccgcccataagaaaagtcatgccattgcaggcagctctcccgctgtgctccgaatcactggaacggggagcaaccttaccaccttggaaatggtcagatcaggacactgtcagagacaacatggagatgggatctggctggccaccctgctctcatagggccacccccacccctcctggcaccattcccagcatttttcagagctaggtctctggaccatctgcctcagaaacacctaaaatgcagatcctcaggctccccaaataatctatagaaccagtgctgggccctggaatctgcatttcccacaggttcccaagtgagcataaaacatgcccaaattcaagcaactggtacacagcagttaagagcacaagctgcagacccagacggcctgggttcaaatcccagctccacaacttactgctgtgtggccttgggcaagtctctcaacctctctgtgcgacacacatctcatctaaaattccaactctccctgactttccctactgaatttttctctgttgtgtttatcaccaactgacaagctacgtatgtttacaaatttatcttgtttcttgtctgtctcccctcttgaatccctgctccacggaggcagggatttttgcctttttttgttcactgcttaatccctaagtcctagaccagggccttggtcacacagtaggtgctcattaagtgcttactgaatgatgaaatctgtaaaatggggctcagagaacttggctcctaaggtttccatgaggactgaataggattaaaaacacgtattaaatgaccaagaaatgcttgtaggatcaatgaaagaaagaatgtggatctggagaggaatgtccacacctcccaggagataaacgaactggcctttctccctccccttctgctaccctcctgcaccagcccctaaggatggactcttggaacttggatgagctcatggctggatcagccctcggctcagccatgccagccagctccacagtggccaggcttgtggccgtgtgcttgggatggcagagacttccgcttccctccactgggagctggggccgggaaactctctctccctcctgccagggccggcagatggagcgttggcaacgtctgcttggtttggttcaatttcacaaacatgtcctgaatacctcgaggcactggaggtggggctgcaatgctgagggagaccccagggctgagaggaagaccctgtacctgttacatgtaatcttaacttaatagggtccttggggagaggcttaggctggacggaggctagctcttaacatgctgcgtttggctaaggggaggctccagcgggaagccagaggaagagagaaggtggggacatttattggccactccatctgtgccttgccatggttctgggttctctaaggtcccagggctggtggcagccctttttccttggccccagctctgactgggtccccataacagcactccctctcccatccactagcctgggggctacaccattccttggaaaccctgcttactccctgtaaacggccttttggttgagtttgccatccgtttcctgcagcgacctcactgccttcccccttcccaccctcttggctgtagaatttgcttgatgagggacagtctgtttctgggagtggggggagaggcgccttctctttgcatggtgcatccccggcaaaagttctaaccctgttcccatgcccccacccccacccccacccccacccccacccccgtcctgatctgccatgggcaggtggtaactttgccagagaaacattctcccaccgcctccaccttggtgagctcctgggcgttggccagattgtccacagcgatggccaagaacacattcaggagggtgtctgcaaatgtctgagtcaggaaaagcaaccactggtgggacaccacttgggccctgggtatctgggtctctcagtaccctcccttgagcccctgcaacctctcctctgccagaggtccaggcctgtccccttctctctctccatgaaggatacagttcccaaagagcgtcagtacaatgaaatagatggagaacaccatgccgccctgcacgcccccctgagacttgatcccgtcgtacatgacctcgttccagtcttcgcccgtcaggatctgaaaggggaggaagaaacacacagccaacccccctctcagccacgggccccttggagatgcagctgtggagccggaatccgcccaccccatccccgagcccaggaggtctttaacaatcctgcccggtttgcagagccagactccgtgttggcttctccttggcttttctctttgtttgcgagtagaaagggccgttcctgcgtcgtggggctcttagcctggcttctaggaaaatgggaccctggaggagtcacagaccctcctgtaactctgtcttacttgatgtgattaaggggatttgttatggactaaattgtgcccgcctccaaattcatgagttgaagccctaacctatgatgggatggtatttggagatggggcctttaagaggtaactagggttagatgaggtcatgggggacttcatgatggtattagtgcccttataagaacaggaagagaccgcatgccatggctcatgcctgtaatcccagcactttgggaggccaaggtgggaggatcacttgagcccaggagttcaagattagcctgggcaatatagcaagaccccatctttacaaaaaatttaaaaaaattagctggtgcccatctgtagtcccagctactcaaggggctgaggtgggaggatcgtttgaacctaggagtttgaggctgcagtgagctatgattgtgccactgcactccaggctgggtgacaaaaaaatgtgatttgcctaaaaaaaaaatagatttttttttgagatttttgtctcaaaaaaaaaaaaaaaaaaagaacaggaagaaacatcacaactctctctctctctctttgacatatgaggacacagcaagaaggtggctatctgcaagctaggaagagggccctcaccaggaactaactaaccctgctaacactttgatcttggacttcccggcctccagaactatgagagaataaatgtttcctgtataagccacccagtgtgtggtattttgttatggctgcctgagcagactaagacaggattttaatatttacctgtgttcctcatgtggtcatggtgatgattaaacaagctactacgtggatagcacaaatgtagcacaaggacacgtttggggtccccctgcctgaggcagaccctggaacaagggttcgggtgcaagtggtttgtctgggaggtgatctcaggaagcaccagtaggggagaggagaagtgagaaaagggaaaagagggtggaacgtaaacagtatgtgatcaagcgagtttccactgtaggtaaccggggcttggtcttgctggggagctctaggggtcatcccacctgagggtgagggagctggggtatttatccaccaacggctgctccttttaaggtgtggcacaaaaaattcacagtactgctggactgcagttccttgggggcagagcaggggaccagagaaagaccaaggcaaaggattaggtgttgacagacgcaagttgtgctgatgcatactgaaagaaccaaggggatattcaaacagcacctacatgctcctttaaaaaagatccaacttccttccttctatccatatccccatgaggataaagtaaatgttaaagaactccaaaaacatgaatctgctaaaacagggtttctaagcctcagcactgctgatatttggggccagattattctatttggggctgtcctgtgcattgtaggatattgagcagcattcctagtctccacccaccagatgccagtagcaccctctccctagctgtgacaaccaacaatgcttgcagacattgctacatgtccttggaggacagacttgtccttgggtgagaacctctgagctaaagatacatgactagcgatcagtgctattaataatcgcttatgggccaggtgtggtggctcatgcctgtaatcccagcactttgggaggccgaggcaggcagatcacgaggccaggagttcgagaccagcctggccaacatagtgaaaccctgtctctactaaaaatacaaaaattagccaggcatggtagtatgcacctgtagtctcagctactcgggaggctgaggcaggagaatcgcttgaacccaggaggcagaggttgtagtgagccaagaacgtgccgtcgcactccagcctgggcaacagagcgagactccatctcaaaaaaaaaaaaaaaatcgcttatgtgggggctcagaacttcccttcatggaaggtttcctcttcaactccctgtcttggggtctcatttagaaactacctccccaggagaaggagagagtgaagtcacattttctatacactctcagtccctcaaagagaaagaatccaccaaagatgctctgaaggtcccggctgggccagtcccaagcctcagggaatgcgcccacatgggtgcagaagttgctttgggttgatcaccctggaatatgagaccaaggtatcttcagatttgatgggtgtattagccattttttttctctgccttttttttaagagacagggccttgctctgtggtgcaggctggagctcacggcagccttgaactcctgggctcaagcaatcctcccgccttggtctcccaaagtgctgagattacaggcatgaaccacctcattggcctggccacgcattttattttctttattctgatgcatctggggtcttgctgactctggagggactgcccggtccagcactagccagtccctagaggtagtaaacaatttagccctgagcaggctttttaaaagcaaaccaaacaatatcccaaccagcccatatcccaaccacctcctttatcttcccagcactatccacctgccctaatcaccccaaggccaggtcctagacaagtaggaacagctcctctgccccagagcccactgaaatgatccaaactagccagtctcgagctgtttactctgcctcacccattccgtcccatggaaaccacaatcaagcctcttgcccacattttccttctcttcctgcttgaccctgttgcttctctgcttggtcctgcatggtgtgctccttctctgaggatctgtgagtataacaaactttcttttcgtttttgagacagggctttgctctctcgcccaggctggagtatagtggtgtgattgtagcttactgcagcctcaacctcctgggctcaagcaatccttccacttcagctgccctagtagctaggaggtatgtatcaccatgcccagctaattattattattatttttttgcagagacggagtctcactatgttgcccagacttgtctcaaactcctggcctcaagtagtcctcccatcttgacctcccaaagtggttttttttttctttttcttttttgagatggagtctcactctgttgcccaggctggagtgcagtggcgcgatcttggctcactgcaacctctgcctcccaggttcaagcaattcttgtgcctcatctcccgagtagctgggattacaggcatgtgctaccacgcccggctaatttttgtatttttagtagagatggggtttcaccatgttggccaggctggtctcgaattcctgatctcaagtgatccgcccacctgggcttcccaaagcgttgggattacaggtgtgagccaccgtacctggccaaagtgctgggattatgggtgtgagccaccgtgcccagccacaaactatctttccaatgacattcatctcctgatctgttggcctcaccataattgaataatgataaccataaaatctgtgtttcaaagtggtgtgaaaaggccaggtagagaaggaggagttcagggaagccccttggatgtggagcaggcactttcatctgtgacactgagaggtgttggcccgtggggccaggtggaggctgtacctgaaacaccgtcattattgctgctggaaaagtatcgaagttggtgggaggagtcccttcatcgaaattaaacctgcagggaggacacagacatttcacgttggccccacccggggtgctctgagggtgtggctcagtatctcatctccaaggaaacgaacgtctccatcatctctgtccccaggaaaccctgagtggtacccagggccctgcccatttgggtgaccgcaatgggtgtctgggctacgaggaaggcagcctgcacggtggaggggactgtgtgttccctgagcctgaccccagggaaccaggagttggaattcctgtgaaggacttactggccgccgaagagttgcattcccaaaagggcgaagacgacaatgaacaggaaaaggagaaacaacaggctgatgatggacttcatggagttgaggagagagacgaccaggtttctgagagatgcccagtacctgccgacagaggccaggcgaggactcaggccaggcgggggaggcagggccccggagtcagccctcgaaacacgaggctcactttcccaactttctggaggcggccccaccatgtcccccatccccaccccctgtacaaatgtccaggaaccccaaagacttactttgtgactttgaaaatacgcaataacctgagggctcgtaacacgctgattccaaaggatgtgccaggttttatgacagcccagatgacctcgaagatgctcccaatgataacctagggcagagaacctggtctcatgtccagggacagtgtctgggctccagaactggcaagcatttcctaggtaccaaccttgcaagaactcaaccaaactcctccctccaaatggaagccgggtgaggatccttgaccccctcattcatccattcatttatctatagagaccgggtctcactgtgtcacccaggctggagtgcagtggcgcaatcatagctcactgcagcactgtcctcctgggcttaagtgatcctcccacctcagcctcttgagtagctgggattacaggtgtgccccaccacatctggctaattttaaaacatttttatagagatagtgtctcgctagtattgcccaggctggcctcaaacttctgggctgaagccatcctcctgctttggtctctccaactgttggcctccactttccaaagcattgagccactgcacccggcctcttatttatttatttatttttatttattcatttattttgagatggagtcttgctcttatcacccaggctggtgtgcagtggcgcgatctcagcttactgcaacctccgcctcccaggttcaagcgattctcctgcctcagcctcccaagtaactgggattacaggcacccgccaccacgcccggctaattttttgtatttttagtagagacggggtttcactgtgttggccaggctagtctcgaactcctgacctcgtgatccgcctgcctcggcctcccaaagtgctgggattacaggcgtgagccaccacacctggcctcttttttatttattaagagctcccacaggcctgagaattcctgaaacacataattacaaagtgaatgtcatgcaactactacctatgtcaacaattaggagaaggctagggcagtggctcatgcctgtaattctggaactttgggaggccgaggtgggcagatcacttgagcccaggagttcaagaccagcctgggtaacacagggaaaccctgactttacaaaaaaaaaaaaaattagtcaagcatggtggcatgtgcctatagtcccagctacttaggaggctgaggagggaggatagcttgagcctaggaatttgagacaggagagggtcatgatcctgccactgcactctagcctgggcaacagagcaagaccctatctcaaataaaataaaaaataaaataaaataaaaagggacatgtggataccctggaagtttccagagacactgtgatataactaccatcctgaattttgtaataaccattttcttaccttaaaaaaaactgaggtgaaattcacataacataaaattcacactttgaattacacaattcagtgcctttaggtacatgcacaatattctgcaactatcacctctatcaagttccaaaacattttcatcacccccaaaggaggccctgtccccatgagcagttactccccactctccctcacccagaccctagcaaccactaatctactttctgtctctatggatttgcctgctctggacatttcatacaaatggaattatgcaatacttgaccttttgtgtttggtttcttttaccgagcgttgtgttttcaaggtcctcgcctttttaacgtattcaagtatcatccttaaaaaatacagtttaaggcggggcgtggtggctcacgcttgtaatcccagcactttgggaggccagggcaggtggatcacctgagatcaggatttcgagaccagcctgggcaaattgctgaatcccggtctctacaaaaaatacaaaattagccgggggtggtggtgcatgcctctaatcccagctacttgggaggctgaggcgggagaatggcttgaacccgggaggtggaggttgtagtgagccaagattgcgccactgcactccagcctgggcaatagagtgagactctgtctcaaaaaaaaaaaaaaaaaaaaaaaaaaaaaaaaaaaatatatatatatatatatatatatgtagagagagagagagagtttaattttgtccacttgaactttgcatgaactgtatggacttacgttgctagctcctgcctccttctgtgccatgttacatgggtgagattcattcctgttgttgggcatgtggctgctgttggtggactttgatt

SEQ ID NO: 590 - DNA, 20001 bp, Homo sapiens
actcagtatcaagacaacttagggttctagaggtaatggcgctacatagctcttttaaaatacattccagacagccacctaggcagccaatgataataacgtgcaatgcaatgggtgtcccgcttaggcacgtacgttagaggttgccagtggatttgctacagggcttgagttgaatgccaagaaattattattttatactgtcaatgtgaaagtcatatggctgaatactgaccttgagctggatttagctttctactttttgcctcctatttttcatacttaatggaataagaccaattatttacattttatgactgcagtttcaatattagaatgtaattggtgcttaatctgtaccatgctgatagccagagatggcaaactcaagagagtatgtaaatggctaactcaacactggcaaggacagatcgttaagcgttcagtatcaagaggccatgcttcatcactttctttccccttcagctgtctaatctgtgggcatttccctgtttgttagcagctccacagaaagaaagtcagagaatgaaagaaagcaggaaaaaagggtttcattaactgaccgtgttctagcagcacatatttacagatggcagggaggaaacacactgtgagtatgagaaagaccaaagtactacttatttgccttccaaggttctctttgctcagggatctgtttgtaacaaggtgacccaaaggcccccaaacacctcagtttccattaataatccactgggagccttttatcctcttttatagaacaacaaggaaatcatattttcagtttcatatcagctcttatggcaatatgtcccatatttcttgcacctgttaatgtaaaatagtatttcctttgggtttttccaaatttatacattttaaactcgcaggggtgccctcgaaacctgttggactgtcagtaaatcatcatctctgctggcctgtgaaattctagatgaaagaatcaaataattagaacaaagttttcatcttacagataaagaaaaaggagcttcagagagggttaataatttattcaaagtcatacagaatttcagttatagaacaggcactcctgattcctattcattgctataattcaatttttcagagtgccctgtcctgttacagctatcctttccagaccttccaaagaactactctttcttagtgtctaccatttagatatgaaggcaatattccaagtatccataaactatattttaagagtagtaaacatttttcatgcatgtgtgtgtgtataattctctgcttcccttccctactgttccttacctgttccgtgccccttctccacctcctttctctaattatcatatttaagaaagaaaacaaaagcgactgcacagtcctacctgtcagctccttgccagaggcattccagggccttatgtgcttaaccgcaaacactaaatgtggcctctggggacttatgagaagaactgagatggtgaacaagccccctggctctttcagctctcctgggctggatgacccatgaggggcagatgactcactgggggaaattgtgaacttgatgggaatggatgaagaagcagcaagaaaatggaaagtgggagagtgctttagagtgccatacttgtcaattctaattatccatacaaatagatttcaatgcaaagtggtgagtaattaaaaaaaatccatttgcctatggaaatgaggggcataatttattttggcagcagattccccttgctaattatatttttcataggatgaaatttaaattaattttcattcttgatcccataggagctggatgttggtgggaagttgtgggagttttcccgggagtaagagggctgccaggtcaagcatttgccaaaaataggcacaagtgggacagtctccatgtgggaaagcactgcaaagaatgggagagtgaacacaaaaccaagaagtctgccaaacgtttggttcagaaaagatgtagaaatgtagaaatgtcccagtcactgttgccatcccaggaacagaaacaagtccatgtcagttatgtcctatttggtaaaaagtagaaggtgactcacaagcaacaaccatgggccatttttggtttaagttacttgtcagtgctttgggtgtcttctaatgatttatctctaactcttgtccatcttttggggctctgcagttctagttaggaactactccaaacaccagtctgcaacaggcaacaattaaatatcactgcacttctattttattcacccctgtttctaggaagggcaggaagaaatgtgcctacaagagacacagggggaaaaggggagaaaataattcaccattgacataattgatataatttcataattaaacccaattttatatcaattcaccattgatataatttcataattaaacccaaatttgagaacatccttcatttggagttctatatatatttcttccctgaatcatcctaacactaacggcttcccaagaaaccaacattttgatgtcaaagctcatttgaaaaggaaaagaacataagtgagacaggaaataatcctgggagagaaagttcctggaaagcataacctttggaaaagttactaatttagaaaactttgcaggcggagggcaaaatatgcatgtttcttattagcaccaaaataccatttagaatagaatttttcaattaaggatgttaaaattgtaacatttcgcagaacttaataagatgataacaatttgtgtaattattgtactattttctgccattttatcaccgtggtaccattttaatgggatagtatttgatgcttttttattagcagacatgattttttttttagactatgtgacactgggtaaagagaatacccataatttaaattaaaatacccatactaaaatggtcatattaaaatggttcacgatgaaggtatatgatctcattaattttgttaatgatttttatttttgtccagtgatagttaaataggagcctagagctgtctttctttgagacttttcatttcagaaaattatctaaatctacaggaaagaagaacttgaaacatgtagcaagtatagtgtacctctttctgacttactgacttaataccaaagcagtctttctaggagatgccttttccctattttataatgattttatataatttaaataaaagtaccaagtaacatggcccttgtctaaattacacaaaaattagagctaagtggtctataaacaatggcagaaatggggatataagcttctaattaaggctctgaaataagaaaaaatttaattcagacaaacattaataggactttgaaacatattttagaatgtttctagcaatactaaaaatgaatatgcagttactagtgaactaagcggaggtttgctacacatgtggatttgttatatgtatggaaataatctattattattatatattagaatactaaaaatgccttaggactctcataactatatataatcttagtttgtaaagaacaaaagatggtggtatagtacgtcataaggtttcaaacagtggttttatttagaaaaagagtgtgatacgtagtgcattgcatatatacattgttttcatccaaaataacttctatgaaaacaattctttgcaacacagtttaaaataagcagacagtgaatttaccttgagccctagtggggggaaattctcttcaactctgaattttaaaaggttcatgggtattcacatcaatgtgctgtggtgttaaaatacatctcattttgcatctaatctccttcctatataggctgataacatataataaatgagttttccctcctattcttgtaccagtcacaaaggagtctatagcaacgtcctttgtgaaattagtaattttagcccaatccatgctgatgattatggagatgaaacaaaaagcactgcattttacatttaaaaaaatgactagctggtcaactacccaggttaataacatttctctgtatggaaaagcttctcagcatgactaatttgtctttcagctaactggaaaaatcatcatatggattatgtatatgtggggtcgttagggaatctttgtacttcacagaaaataattagagtgtttcttgcagatattctggaaagaccaaaggaccctgtgaaagactgcagatgagagaggaaaagcatggcaaataaccttagcattaggaagtaataagaaaataaaaatgaaattgtgaaagccaaacataaagtctttttgtttttttggtacttctgtacagtgaagatataccctaggctgtcaggaccatattaaatgggtcatagttaaattgagtgcctctgataaggggctctgccaggctatcaaagttttccatcagctggattgaatttccagcatattgcacattttcacacattcattctctcttcctcctttcagtgacaccacaagggcagccttagatatgcttacaatttgtggttttataatgcaggggacatctgtgttttcaaagaagggatgataccatggaagccaagagcagaaatgggatgagggaaagaaaaaaaaaaaaaaaacttttgcaacgaacataatctgcatataattttggagagtttgtaaaaaagaccttatggctctgtagagtcaagagctatttgaataaaaaaatttaaacatccatttctctcaaattaaagtctgtgaaacttgaaggaaatctaaacatcaataagtatttatagctaataattaataactaataatgtcaaccatggtcactttaaaatctcctctactcttgaatgaccccagaaaataatgcagggaaatatttcaagttttccctcagaaaattgtagtatgtcctatattttaataatctctttattagagtacaaaaagatatggatatagtaattccataaagagaatattttgtgtttaagtgctctggaacttgccaaaagcaacaatgaatactattaaattatttacacaagtacatgaagaatgtacagagagtaagtgcaatttaaggtaattttaaaacaaaaatattaactgaaactagtacaccccaggaaaatataaaaaatactctttcatttattttttatttatttttttgagaaggagtttcgctctgtcgcccaggctggagtgcagtggcacaatctcggctcgctgcaagctctgcctcctgggttcatgccattctcctgcctcagcctcccaagtcgctgggactgcaggcgcccaccaccatgcctggctaattttttgtattttaatagagacggggtttcaccgtgttagccaggatggtctcgatctcctgaccttgtgatccgcccgcctcagcctcccaaagtgctgggattacaggcgtgagccaccgcacccggccttattttttaatttttaaaaagaaggctactccctgagttctggacctcacaatagactaaatgatagggagccaagttccaaaaaagatttcttagtcttaatagcctctgtctaagttgcatgaattggacatacaactttcataaaacatgaacaatgcttaaatcaaatcatcaaaataggcaatactctcttaaattgtttagcacttttatttttaaaatcatgttcattcctttttggtggcaggtgatgttagaaataatcatcaaaacaaatttccagcccagtggtgtaatttgaagatgataccagtagcatcatttgcctggactcactgcgattatactcaacgttctgaaaacagctgggaaaagcagcatttcctgagagccaggcccactcgaggtccagctgccagctctctgctgcagttgtcaccaggatttcgctctctttttacaaatcctttttcactgaccttttctttcccccagttgcaatctcttacccatacattttcattagcaaacggtagaaagaccccagccagaacatctcagattgtagcacttgataccaggatggtggagcacttaccagggagtcttttggtacttccatatcggctttgattttcatgtttttcttgtggtttccttgagtactgatagagctgccgatgagacaggagccctgagaactgccctttaacacattcctgcaggaagcattacttgatccactttctgtctgtggagctgctttcttatcaactctgcaggtagaaagtgattcctctgataagttaccttgctccttcttcaatcactctccttttcccaatctttttaatatttaaagtaacctctttgtagctctttgtctttaaacctttgacggataagggtttctcatgggccttgatcaaatcttcaaatattctagtagcatgtcaatttagatttgacaatatcataatgtattttttatttttgtgatttcttgtggagaggggcaaaataaaaaccactgaagagtgattattaactacatttttagcttaagagcagcaagaaatataattatttctggaaagtttccaagtatatgtttgctaggtataatcaacgaaatcggcatgctttaaaacgtatgtgtaattttcttccatttcacgccatctgggtacattcatagctcctagtgtaggtggaattgctatcaaccctgataaaacttaccattctttaatttcaaaggccattggtttggttaacaaagtaacatggactaaatgatcattttattgctaacttttatttcattgcttaaattctggctaatgtataaaagactgctactattcatttctgcctgtatgaaaaaacatgcttgactggcctttaatgcacaggaagcaaacaactcttttaaaggtggtggagggacccctctacattgctacctgcttttccagtgagttacctgttcaagagttccgtcatgaaggtgtctttcgttgaacatgcaacagggctgtgtctattccttggttcaatcttcagttggttgtaaatgtcttgtggtgttctccgattatttttgctttgtaaaccgccatctggattatctgctgacttggtgtccttgataagctcattttctgtctcacactgtagttcaggcttctttttctctttttttctttctgattttagttgtctgtttccaaaccccaagacttttgcatctttcttttctactttggttttggagatgtccattttcctgctactcagagctggaagtctactcttccgaaaaccaaaccagctggcaaaagaaggcccaggcttctgctttgcttccacagaggtgggctttgtttgcacttggcccttttccacattttcctgaatgcacaacatgaccttttcttcgattgtgggtgagaggggggcttctgaactcacagcatcagtcgcggttgcagaggcatctggatgccttccagaagtttctagcttggatgtactgcttgtttcaaaagtgcttggatgctgagtcctccctgggctctgcagggcttcagggcagtctgttggggtgggtgggcaactgcggcggtcactgcctggttccccaagtacagccacattggcactggggcactctccctgggtgaaggcctgctggtcttcctttccaggtgggatgaggagtccctcagactttggagggatcctcaaaggcaacttacttgggctcccatgctgactgctgaagctgcctgagctccccagggagcccttcccggaggaggggtgccccgagggcctcccaacactggggagactctccaacatgggagcagaaggggccttgttgggagagctttccgtggaagagttctgccgggtaagagaattgcctctctcggcggtattggtaatgatctgagtgcggactttgcctgacccttcgatggggggcgtagaaggcttgtctcctgagtgtgtactgaagctgtggctgcgggctttggcgccattcatacccagagctggttttaggtgtggtttgctggaggaaagggatcttctcatggatctattatctaccccatcccttccatcactcccagggatgctactttccaatggctcttgtagtgctgtttccaggggaagcccatcagctaaactgccctgtgcttgtgaatccggtagggtcacatttctttcacccgctgtgatctccatgcttgctggattcttggagtcctctggcttagacttgttcacagccacggaacttttggaggcttcatttaaactgtctttttcatgtttccctggcacggtggaacttttcctgagcagctggggagacttcatgagcactttgagtcccactggaaggcgagttttcagtcctttctcatgagcactttgacaaccatgagggctgttatggcttttggcgggtgatgaggatgatgaggaactgctgacctgagatgatggtgactcatttacccctaagaaggaaggcttggggggtgtggaggcgctatcattcaattgtccttttctccctggagatacacttttggaggacgtcatttccagtggctcatgggttgaaggagagatcctgggagtctgtaatcctatgtccctttgtggggtcccaagtgtttggcgaggagaggttttggggacacctctcttcggagagacctttggaggccccagagccattacggtgaaggagctggagggggcatgagcagggcatcgggtttgaatgactgcttctggggagggcatagggtgagtgaagataggctttttgaaggccacagaaggtttcttcctctgcacttctgtcgtggccggattagaagaaataactggagcagaaattcctttcagcagcggggatttgaatggggtccttgctgtttcactggggaccctggtttcggacttggtggatgaaggtgctggtgaatagtcatagctgggcctggccagcagggagacggacctgcctggagggggcggaggggaaggggatttcacccctgcctccggcccagagccacagtgttcatccctcgtggggggctctccactgtcactagactcaatggcaggccttgaccgtgaccctggagtctgactcttggggcactggacccagtccctcctgctgggcatcctggagctgtgcggaagttgggcggaatgttttggaatgtgtggatctgatcgtaattcaaagaggggccctgagctctcagtcttcatgaatcgtgagagtttcccaggagctaaggctggtgatttttcaagagtcaccaggccagatgaagggagtagtgtggtggcttcgggctccattagttttgatttctgaggtgaagacttgcccctgggaggtatttttgtcagattttgcttttgatagatgcccatgggtgccgaagacctggaattactctggcatgatatattgtgtgttggtttgaccagcttttgctgctgaggattttgtgtcactgtcctggagctgaaagattcagtggacaccctgggaacattatctacattatcttttggaatgtttttctcagtgtcctcttcagaccttttaaagaaagtatagtctcttgcagcagctcttggctgtaaacaagcaattccctgaggtaaaagctcagtatgttctgccttgggtccagcaggagttgaattgatggaaatctcatttctggtaacagtgacaaccccagtctggtgagagctgaattcaatgggctcaccgtcttccgcatcaaatatcacagtcacacattcttctgaagaagtcctttttacaactctttgctgcttaatgaaactaaaagtctttggcctagtctctgaagggatgggcacttgtttttcctcctcttcaggagacccacatagagattttccaaaccccacaaggacatccaggttctccacggacttatcggtgtcggcagccaatgacacgtctgaaggacttttctcatcactgctctctatgtgcagctcatcaaacgtttcattgtcatcagtgtctgaaagctggaggttgagagccatgcggccatggccttggccctgtgggcccctctccctctgtacctgaggcgtctgcacacttgggcacagcttcatctctaagggacagctgctggcgcaacttgtcagcttttcaggcctttccttgggataaactgaggatgtgccttccagaaagtgttttctgtttgtctcccagccaaacagactgtcggaaacactgtgggttaatttactgccatgtggcctgcagctctggtttggaactgcttggagcaatgctaaggtggaagggtcatcgtccgcatcaacgtgggaatctagatcataaacaaatgtcttgtggggttccttgcaggggctccccaggtcagctgttttgcaggggggatactccttgaggctgctacttttaattccaggagaatatattccttcattcgagttcatgcaatctttataaccccatttggttatcactgatgggggttcaagtaacacttttcgcttctgtagctttcttagcccttccaaaatgtggctttccttgatacgagttggaggtagttcatttgtaggactagcaaagccacttgggagcgaagaatcaatacttagccttttatcccagttttgtgatgattgctaggaaagaaaagtagacatcagaaatgattgaaccatgtagatcacaaagatataaaaggaaaagtacatcatgggacttaatttgtgctagtggttggtaactattcacatataaatgcctacattaattagctaattaatttattcacaaactatgcagcaaacattgattttgccaggtcctgtgctaagaagcacagcgatctaaagaaacagaaggtaaaggccctgtcttcatgggaggaatcccagtggggagaggagaattggccacaactaactgtatgtcaagggagaaaatgggaagtgcaaatgttgtaagtactctggagattcagaggagggaggccacagacaggtctatttggagaaaggcatataggaaaggtatatatatttttttcttttaaacttacctagctcttgaaagacacataggtttgccgtaggttaaaagtgggggaaatgttttccaggtgggagaaatggggtgggcaaagacctaagtcagaaagtacattcaaggtacattgagggaatgactagaagatgatatggccttattgcagagtgtctacgagaggtgcagagggtaaagctggaaaagtaagttggttgatatctttatgctcacatttgatagttctgtgacttcataactttatttggtagacaatagatatctatgaaaattttcttaagttactacactcatacatatacacatacacacatacacagcagctgggcattcgctgttagaacctgacagtaattattcacctaccaaatttagaaaggtcaatttcctgcccatcacccttcccaaatgccagcctcagctttggaaaagtgtatgggaaatgacatagagaaaaggctgtgctctacatattcatatttttttcatagtattgctaataagaaatggaagggggaaaaaaaaaagctaacatttactgagcctctgctgtacaccagccatttacagggtgctttcactccatcttcagaacagacaactgagactcattgttgggtctgttggagatcacatagaaagagctggagcaaaggtatgacctctggtttctcaggctctttctatagtacgtcggttttgactcagttcaaaagtggcagtgaggggacatgaacccaggcagtctggccccagagcttgcagtcctaactgatgctatatataaagccaagcttagcccctcttctcccctttaccttagtcagtgtcataatagagatcacaggttaccccacactatttcttaaatggtacttgcagagtttagggggctgacctaatgatttcttaagaaggctatatgggccaggcgcagtggctcacacctgtaatcccaggactttgggagaccaaggcaggtggatcaaaaggtcaggagttcgagactagtctgacccatatggtaaaacgccatctctactaaaaatacaagaattagctgtgcatgttggcgggtgcctgtaatcccagctactcaggaggctaaggcaggagaatcgcttgaacctgggaggcggacattgcagtgagctgagattgcaccattgcactccctcccaggtgacagagcgagactccgtttcaaaaaaaaaaaaaaaaaagggctatatgattaatggtaaagagcttcaagagaaggctctgggtttcagaaatgcactctataccagttttggctacatcagtctcctccctgccccacacgcttatgtgcagtggttgaaaaacatgtcagaaacttccatttgaatctgggcttcttagtacactgtaaacatttgctcacatctatggcattttcatgaaaattactcttgctatcaacaacgcacacatttatttgtttttaaatcaaattataaattttctttaggaaattctccaccgtcagaagttgctggcagtagatgctattcagtgatgctgccccacttcctcttccctgtaccattacaaactcctttagaaatcagaagaaatcccattagtgaatctgggtattatagctccaccagaaaggagctgccacagtgtaagtttctaagaatttccatgatcctgatagtcatgttgacaataaataagagaaaccaagccaaagtaccccacaagagcttgaaaaatgtggatctgtttgacccccaagaagacatgctcaacctctgtcttgcctcctttctgccattctggagcctgccaggtgctgcactgcgacttgccccagagccagtggctgcaaacctcccagggcccaggctctctgcctggtgagattagccacattcctccttcagtcctctataggaggttatagtatctaacaactggagaaaagtctaggccaatcttgaagcttgggggtaggagacacacgaatgccccgtgggagtgatggtggggaggagctggcatttctcacaggcagatccatcctttgctgcgaaagttggaagagagttgctcttgggaagcagtgtggttgactaaaagatgctgttgctgaggtgcaggcctgtgtttaatgtccacagtcctcttccatttcttgactggacaagaatcttatatatatatatttttctaaagggtcttaatgggagcaaactgatctcaataattgaagcaacctcaccacgtttcaggctgattcaacaaggccagtataaaagaacaattaagaatgtgggttctggagccttctggcgcctggctctgccatgtactgcctgtggcatcttggttcagttatttaacttcttagcacctcagtgtcctcttctgtgaaatggggagaataggagagcctacttaataggcgactgggagcattacatgatctaaggcttctgaagtccttaaaaggctgtgctgcatatggtaatttctcatcgactagagccacattcctctgtagggcaggctagtgcatttcatgcaggcttcctttctgtttgtacacaagtaaaacatacttgtgagctcaaaaagcacaatcaataatatattaattgttatataattaatattcaaattcaaattcatatgatacaagtttattatgtaagttaatactacatgagtacccagcacaaagtaagaaactgcagaaagtttcttaagtaatacacatttcaaatgtcttcatgaatctgggtctggcttgttaggtccctgagaaacaagacagttcactgtgagatatgacaggtgtactggtactccatgaccatgacagagccctattaaggatccagagaagagccacctgagtgtccatgaagtgccttaagaaccttctttctcctcattcaggggagagattgccttagaacatcaaaagctactgtaattggaagaattccagccaaaaattaaaagaaagtgaaaagcctttgagaaggagagagacaaagaggtgtgaaagtgaaaagagcagagcgaggggctctgggagccagggatattcacaaagcgaggaaacatccctgaccatctgtccagtctgttccaaaccaggctcagagcagtcattattcagagcacctaacaactccttagagggagcaattttgataatgcagcaggctctgtactttgcattggaagtctgagtcccagggaataagccctaaatgcaaccttgagatcttctgagttcttgttcagaggatgacaaagctactccctcatcaatatctcctgggagttctggatttttcttggtttctacactgctaaaaccatgaactaaatttatacaaatggtagaaaaatgacctccaaatactctgatccggggtttctattcttgtgtgctctttccttttctccaacattagggaatggataaaacagctatttcaaatatttcccttacatcagtgtacaaagacgtctgctcaaagcacaaaggtatctccagctttgcgagtccactgtgcagatgggagtcattctagtagtagtaattattaaaaatcctggtaaaggaaatcttggcatgtatataagtagaaatatgcctacctacactgaagttgtggtctctgtcatctcaccacgctgccctccaatttatagtcaaatagtgttttatgaggctatagcattgatgaaaggatgtcagtataatacatgagcaggtgctcagcaaatggtggcttccttcttacccctcccacctgcccttcatctccatgaccaaatcctaccagaagaggattcttttctggttcattccgatgccacagtgccttacccttttcctgaggttcttcccatcgtgccacgtgtaggaggagccactggagtactcgctgcaggtgcttgaaagagacagttcactgctgctactgtagctgtttcgaggacagagatgaccagggatgacagcccccaagccagggcatttcaaggccgattttgtatttagttggtgttcctgaaaaagcaggacagctctgagcaagggctttgctcagaggagagtaaatatcaacacaaccttatggtgaggtagatgggaatacagatgctcctcaacttatggcaggagtacatcctgataaacccatggtaactggaaaatcagctgaaaatgtactcagtacacctaacgcacagaacatcacagctcagcccagcctacacttacattagcctacggttgggcaaagtcatctaacacaaagcctattttataataaactgttgaatatctcatgtaatttattgaatactgtgctgaaaatgaacatcagaatggttgtatgggtgctcacagtacagtatctactgaatgtgtattttggctccatcacaaagttaaaaaatcctgtcgaactaccctaagctgcagattgtctgtatggtatggtatgataattacgggcagactttggagtcaaatttgggctcagatcctggctctgcctcttcctgtgtggctatggggaaactatttactctctttcttcaaaggaaatcatgatactattgcttatcttatagggttattgcaagcactaaacgagggtctagttgtgaagcacatcacagcatctggcctctagtaggtgctcaattattataagctgccatcattattaggcaaaagtaccacaagggtggtcttattttatctagccatactggtgagaatatcaaatcagtatcaaaacatgactcgaatgctacaaaaggacgaagatagagtcacatctttgactacaggcttcaaaagcatgtaaactggctgtgagtctagtggtctggatcccgggctacccactgccactaagcatgcactcttgagcaaggaagacttctaacttctgtggtctttaatgtcctctttatagagggtgccgctgtctgagatttctgctacactttcctctggttctgatggcatcatactaagtccacaaccagatgcccattgcctatctgtgctacctcacaggaagccaagcacagcagacacgaaactcaggtataatgagcctccactgtaaatataatagtgcttttcatatccagtccttgttaccatttggctatccacatggtaataaccctcacatcaggtaggtctgggtttttagtggaaggttcaagctgttagaattctagtggttcttcataaggcaagggtgacaaataaagctgtaaacctccaaacacatcttgacagccacattataggcccctcgtgtaacagatgaagctctacaaactggacaggctaaattaatttacatcccaaccactgagaacagaatctctctattgccgtctaattccagtctcctttttatataaagctttgtctcagaaactctttgatggtaagccatctgtctttgtgtcacttgcagagtggcaaagccttttacttatacaatttattgacactttgtgggtgcctttcagtacctgagtacttatcaccattctccaaatgcaattccaactgacggtgactaaacaccagcttgggaaaggaaggtaatgatgatcctacagtacttgtggtaaatattaaactcctacatcagtacacagggcatgtttaatttactctctaatcaatacctataatgctcaattcccagttctcttttaatgaataagcagccctgcccactcatgtccatgtgtatacctcctgtatagatgttggggtaagatgacaggaaagtaggactcagaagatgggctggagtgagaaggaattgctgcttctcccttggccttgaacttgagatgctctgttttgttttgttttgttttgttttgtttttcagatggagtttcactcttgttgcccaggctggagtgcaatggcatgatctcagctcttaataacattagattttcagtattaggcatctgccttactatcaatacttcatttttgctgcatagcaatctctttaagtgatctaaaaatgccaagaaattttactatcctatttcttccccctgaaatttggctctacatattattgaaaggagaaacttgtcttaaaatcaggctttcagcaatatctactgatttatgaacttgtttattgccggacgtaacttagttaaggggagttcatatttgtatctccacagatgcctacaacaaatggttgtgtcgcagagcagcaactgccatttcagcctcagccactgttggcacctggaatgtgcactgaacaaactttcagaaatatctcatcaggcttcacttctactgtgtgctttctgttttctcctgtctgtcctctcatattttgttgtttaaatacgcagtgtggtggttgttatttaggactgcctctgctctgacagatgtgtctactctacagagagagagagagactgtgtctattgtcccaccaggctgtccagatccaaactccaatgacctttctgcactctgcctggctattggttacagtttacattctaccttctcccaaggtattgagggaggcttgcatgcaattctctgtccttcccgcctgttcttcctactacttctattaaaattatacctatttttacaactcaattcccaggtctcttttaatgaataagcagccctgcccactcatgtccatgtgtttacctcctgtatagatgttgggttaagatgacaggaaagtaggactcagaagatgggctggagtgagaaggaattgctgcttctcccttggccttgaacttgagatgctctgttttgttttgttttgttttgtttttcagacggagtttcactcttgttgcccaggctggagtgcaatggcatgatctcagctcactgcaacctctgccttgcctcccaggttcaagtgattctcctgcctcagccttccaagtagctggcattacaggcatgtgccaccacacctggctaattttgtatttttagtagagatggggtttctccatgttggtcaggctggtctcaaaccctcaactgaggcaggtgatccaccttagtttcccaaagtgctgggattacaggtgtgagccaccgtgcccagccgagatgccctgatgtgatggcagatacttgagggaggtggagaaggcctgtgaatgtcatgtgggagcaggcaggggcaaagatggttaagcagagaggtgtcctctaagacaggcttttcacactttaacgtgaactgaatcaccaagggatcttgttaaaatgcagattctgattcggtaattctgaggtaggacctgagatgtatgtagtatttttaacaagttcccaggtgcttcaatgctgctattctgtgacccatgctttgcgcagcaagcctctaggagaagctattaaagaagtcagtctcttatgtgagttccctagcagcacgttgtggtacctcactgtctgacatgggctgtgctaagccaggcaaagggaatggctgagcctgcctgccagcaggcacgtaagttaaggagagtgtctgtgtaggtgtacgtgtagcggtagttacagagtaattccttgcaaagaagaggaggcggccactcttttctactgggaaattctcccacttcccccaccttggaaaatcaatgtttgaatttaataagggatgcggaatccctgacatcctggctgcaaagtgagctttttttcccctacagtttccttcgtcagcatgtgattatcacataggattatctactgcagtaaataactgttctgtggttgagcacttgaactccaaggccatttatgaggtttaaactctggctttcacttgctagctctgtgagcttgggaaaattactgaacccctctgtgactcagtttctttctttgtaaatggagatcatgaaagtagttactatgtgggatcattgtgaagactgaacagcccctgacaaacgctggtgcttagggacttttacctgggtgttgctactattattaaaaatgtttatacatatatatatatatatatatatatatatatatatatatatagagagagagagagagagagagagagagagagagagagagagagggtggcgggaagagagagagaaagagagagagacagagacagaggccaggcacagtggctcacacctgtaatcccagcactttgggaggccaaggtgggtggattgactgaggtcaggagtttgagaccagtcaggccaacatggtgaaaccccgtctctactaaaaaatacaaaaaatttagccaggcatggtggtgtgcacctgtaatcccagctacctgggaggctgaggcaggggaattgcttgaatcagggaggtggaggttgcagtgagccgagatcatgccactgtactccagcctgggcaacagagtgagacttcatctcaacaacaacaaatacacacacacacacacacacacacacacacacacatacacatgtgtcttggctcttcaactaagccatcagttagttcatggtctccctacgggaccctgttttacacttcctgatatcctataattccctgatgcctggtacctaagtagtaactacattaggcaatagccaaaagtggatggactttgttaccagggatcactgatgtgagcttctggcttctggagagacatattagtagagccctttctcagtgatcatttctacctttgctgtggtttgctgtgggtgcagcatggtaccacatattaagagaactgaagggggccaaaggaacagagatcttatgat

SEQ ID NO: 591 - DNA, 20001 bp, Homo sapiens
caacccagctacttctcaccaccccctactaccatcccgttattcctagatgccttcagcagcctctgaaccagcttcctgcctctaggcttgaaaccctaatgcagtctccacacagcagctgcagtcatctctctgaaacacaagctaggcaatgacgcttgtttcaaaccctcctgttacacttatataaaagccattctccttccaaggcccctccacctctatgatctcatcttgtagagctctctcctttcctcactctgggtttttggacacactgggctagttcctacctatgattgtttgcacttattattctgtctgtctggagaactggtttccagatcttgcctcgctgactcctcaccattcagccctcagttcaagtgtcaccttctggccgggtgtagtggctcacgcctgtaatcccagcactttgtgaggccgaggcgggcggatcatgaggtcaggagatcgagaccatcctggttaacatggtgaaaccccatctctactaaaaatacaaaaaattagcctggcgtggtggtgggcgcctgtagtcccagcaactcgggaggctgaagcaggagaatggcgtgaacccaggaggcagagcttgcagtgagctgagatcgtgccactgcactccatccagcctgggcgacagagcgagactcgagactctgtctcaaaaacaaaacaaaacaaaacaaaacaaatatcaccttcttatagagtggcttctgttcagtctaaaatagcagcccctgcatatctttctgttccattatccagccttgttttcttcacatgcttattgctatctggaatgttcttgtttgtttattgtctgtcttccccatgaaaatgaaagctccattttatttctttttgagacagggtcttactgtgtcacccaggctggagtgcaagtggcatgatcacggctcactgcaaccttgacctcctgcgctcaagtgagcctccctcctcagcctcccaagtagctggggccacaggcatgtgccaccacacccagctaattaaaaaaaaatttttttttttgtggaggcagagtcgcattatgttgcccaggctagaatgtaagcttcttaagagcataaacttgccaggcacagtggctcacacatgtaatcccagaactttgggaggccaaggtgggcagatcacctgaggtcaggagttcgagaccagcctgaccaacatgatgaaaccccgtctctactaaaaatacaaaaattagccaggcatggtggcatgcgcctgtaatcccagctacctgggaggctgagacaggagaattgcttgaacccgggaggcggaggtcgcagtgagccgagatagcaccactgcaccccagcctgggcaacaagagcaaaactccattccccaccccccaaaaaagcataaacttttgtgtttatcactgtatccctggcacctgaaatggtgcttggcatacagcaagcactcaatatttgttgaagaaattaagagtattcatggcctcttatgttttaatctagatgcattaaaatgctttaaaaatctcagtcttggccgggcacagtgcctcacacctataatcccaacactttgggaggccaaggcagatggatcatctgaggtcaggagtttgaaaccagcctggcgaacatggtgaaacactgtctctactaaaaacacaaaaattagcggggtgtgttggtgcatgcctgtagtcctaggtactcgggaggctgaggcaggagaattgcctgaacccaggaggaggaggttacagtgagccaagatcacaaaactcagtcttttcattctgctttacataagacagctgactgccattaggatagttttctttttggagttggtgatacctaggttgactctgagagtccaactcccaaggccagttgggagaagtttcagtgctacacaagagagttttgagcccagtgggccctctgggccccatatcactccatctggacaataattcctgaggtccatggtttcatgggccaacccagtagaaggctgagctttcttatctttgatatgttaagtggctgggtctcttctttgggcctctttgttccaggtgggagacagaagagttctaaccttcagtctgtagccaaagccagagttaaccaacttgagatcattccctagcttactgggttgacagggtctctgaaaaagtcccctgtttcaactgcactatgtaacacagtggctgaaatttcacattagcaactacttcctggatagggttgctaaataaaatacttttatttgctaaatctggcagacctagtcctggttttggctgctatctggaagagggactgaactgtacaacagtccccccttacttacaaagatatgttgtagggcccccagcggatgcctgaaatggcggatagtactgaaccttatgtactgttttttcctatacatgcatacatatgaccaagtttaattcataaattaggcacagtaagaggttaagaacaacaataggccaggtgcagtggctcatgcctgtaatcccagaactttgggaagtcaaggcaggcagatcacttgaggtcaggagttcgagaccagcttggccaacatggtgaaacaccatctctaataaaaatacaaaaattagccaggcgtggtggcatgtgcctgtaatccaagctactcaggaggctgaggtgggagaattgcttgaacccaagaggcagaggttgcagtgagctgagatcatgccactgcactccagcctgggtgacagagtgaggccctgtctcaaaaaaaaaaaaaaaaagaacaataatgatatagagaaataaagcaatgatagtaatatgccagcatcactgctcttgagcggtggggctgttatgaggtagaataagggttacatgagcagaagcatcgccacagtcgatctgataagggatccggctactcagtggctaatgggtaggtagtgtcaacagtgtggatacgctgcacacagggatgttctagacatgatggagtaggatggcactagatttcatcacactactcagaatggcgtgcagtttaaaacgtatacattgtgtttttctggaaccttctctttaatattttcagactgtggttggctgcaggcaactgaaactgcagaaagtggctaatggggggctactgtggtgtgatttccaggcaacatgagggcccatttgaggctagtggccatgcgttcgaaacatcagtcagcatggttctggatttttctatggccactgtttagctgggtgagtgcagacacagagctggggacaaaacaaatttaaccagggttctggtttagtcaaacaaggatgttgaagctagtgggaggcaagacagttgaggggtacaaaagggagtgaccctggctggccatggaactgaagactgggaggaaggagataaagaccgaggaggggctgctgtgcacactctgccatgtggaaagaggggaagcagagcccgagtcccagataaatcttaattccagcattaattaatccccatgtgacctcaggcaggacactagggatttcaatttcctttccttcatcctgggaaagggaggccctgccttgcctaccttacagagttgttgagggattcaaaggaggtacggagagaaggtgccttaagcataaagcagactaggcgcaggggctcatgcctgtaatcccagcactttgggaggctgaggcaggtggatcatctgaggccaggagtttgagaccagcctggccaacatggtgaaaccgtgtctctactaaaaatataaaaattagccaggcctggtggcaggtgtctgtaatcccagctactcaggaggctgaggcaggagaatcgctcgaaccccggaggtggaggttgcagtgagctgagattgcaccactgcactccagcctgggcaacagagcaagactccttctcaaaagaaaaaaaaaaagatgcataaagcaggatacaaatgctagagactagcctttttatttcagaattttgcctaagactatcgggagactccttttctggggacataaggccaggctagagcagcagtgacttgccatggcctaggaagagacatttaggaagtgccttgaggccctgctcatcctcttgctttgcccttggagagcaacagctgttttggactaagcacttaagaaaggttaccttgttagtacctcgtaatactacctctccccattctccagagagagaaaaaaaaagaagttttaattgctagtagctattagaggtgggattaaaaccaagctctaggtcgcttgttctatgatattctgagtttccaggcaggatgtcctgaggcttgatctcttggccgaggactcattatttctggatcattgcagagatcttcttagtcccacccacagtcgacttacagccctcagcaaccctagggcaggggagtgcaggggtttgatgggtgggggcggtgctggagctcagggtcttgatttctaaatcatcttccacctgtgaagtgcaggctgtgccaccaggaaatgggattgcgtgactgacaacagataccatgtacccagaggcctggatacctgtgtggagttactagccctggcccctcctctgcccacctcagctggctcccctgtttgggtgcaggcccagagcttgcctcgtactctgtgaccaagtcaacaggccctgccctcccaggccgtttctaacaacatccacctgctgagagccacccagcgagtataaggaggaggctggctggccgctgcaggcctctcacagatctatccctgctcactatcctgcagcagacagagagacaagaccccagccagcccctgtccaggcagcatggtgagtagaaggggccttggggggactgagcatgcaagtgagggtcccagtgggcccaagatatctggcgtgaaggtaccttgggagtccacatggtgatggggctacagtatgtggcgaggtggggagagggaaagagacttccagatgtggctgtggcccccaaatgtgcaggtgtggggggcatcacagggggtagggaaggaaagtttaatggtaaccaggttgtggggctgagcctaggctgagaagcagggctgctgagggggtctgaatttaggtgtggggagtgtgggggaagcaggacttgagcagaaagtgtaggcgatttcctctgctggctgaggatctccagaccctgggccttgccacaggttcactgttgggctctgatcccaccttcccaccatggggacacatcctccatggaagcttctcccctctggttcctccctccaccctgcccatctgctgtgcctttgtctgacctctcatgtcagttacagatcagtggggagaagaaggaggagggaaaagggggtgctcccatctgtcaagagctggctgtgcctggggcttatttgatatcttttacccacctccctaccaggcaggatagaagaacagttaagagcatggttggtgccaggccatccctgctctaaatattcttggttttgctcatggccttgagcaagctacttgacttctctgagggtcggtttcctcatctataaattgggggtaataaaactacctacctaaggtgaatgtggtaaagattaaatgagataatgtgtataaagtgccaccttcacctggcaccttattagtgcttaataagcagaactaagcaatgtaacaacacaggccgccggctatgagattcttctctttctacagtcatgaaaaaggtgctagggaagctgaggtgaaatgacttgtattggatcacagagagatgggggtttgaggccaggtctgtgtgactccagaggctgagttcttttttttgtttttttttttttgagacggagtctcattctggagtgcagtggcgcaatctcggctcactgcaacctctgcctcccgggttcaagcgattctcctgcctcagccacccaagtagctgggactacaggcgcttgccaccacatctggctaatttttgtattttgagtagagacaaggtttcactatgttggccaggatggtctcaatcgcctgaccttgtgatctgcccacctcggcctcctaaagtgttgggattacaggcgtgagccactgcacccggccaggggctgagttctttgccccaaaactgctgcctccagtgtgagacatcattcccagaggggccagagacaccttgcatgggctagtagttctgggggccaggacgatgtctgggtctgtggacagaactggctggtcaggctcagaggtgcagcaccaggcaggtgattggtgagccaaggcagccccaggattggacctgggatttctcctgtccttgaggtctcagctcaactcattatctttttttttttttttttttttgagatggagtctcactctgttgccctggctggagtgcagtgatgcaatctcggctcactgcaacctccaccttctgggttcaagcaattctcctgcctcagcctcccgagtagctgggattataagcatacaccatttttgtatttttagtggagagggggtttcaccatgttggtcaggatggtctcgagctcctgacctcaagtgatccacctgccttggcctcccaaagtgctgggattacaggcttgagccactgcgcccagcctcaattcattaccttctcttactatgacatcagggattgagggtgggaaattggaaggggaacccaacatgcatggcacaccctagtgtgtgttaggcagtgggccaggcactttgcatgcattctttcatttaattctcatagtttttctaggaggggctcttattattgtctacatttcaaaaggagaacattgacaaagaggttaagatttttgctcaagacaagtagagaagtaattgggctggaatacagattatttatggattaatctcagtcatctaaaaatcatgaaaagtcaggcctttgtgttatataaaaatagtcaatgaagtgttacatttttggagaagtcatcctcattaaacaattaagaaatatttcaggaatgcaaaaaggtataaataataacatgataggctgggcggcggtggctcatgcctgtaatcccagtactttgggaagccaaggcaggtagactgcttgaccccaggagtttaagacccacttgggaaagatggcgagacctgtctctacaaaaaaatttaaaacttagccaggcatggtggtgcatgcctgtagtcccagctactcgggaggctgagacaggaggatcccttgagcccaggagtccaagactgctgtagttaactatgatcacatcactgtactctagcctgggtgacaaagtgagattctgtctcaagaaaaaaagaaaagaataatgtgatgaacagcagctatcaagcttgagaaatagaatctgtctccaattgcatctatctgcttcccctgccagagagcaccattattccaaatttggagttaatgtctcctgtgctttatctttgtactattttcccttgcttccctcaccaatggctcctaatttctttctggacactggtgggtagattatcttgcacttctagattcattcgattccttcaatgttgctcattgagacaggcactgagcaagagtctataatctcaggactgcccgcatcttctgcttcccccaatgattttggcccagcccctacagccgatgcctgttgctcctcagtgccaccagtaaatgcttagatgcaggaggcgaggcaagcagagtagagtccaggaaccttggccctcagccaaagagccactcaaggaaggcaggcaggaaccatgtccaggcatgatatgtttccctctgtgaaggccgttctctgccctttgcccactcagtgtgagtgcatctcagtccacgtggggcaggccggtgtgcagttggcaatgcctgctgggagctctactgcctggaacataggattcagtctgatgggcagatgcccagtgacaagaccatcaggggagggggatgactccttcaacaccttttttagtgaaactggggctgggaaacatgtgccccaggcggtgtttgtggatctggagcccgctgtgatgatcagtcccagccacaaccttgtccctgggtaccacagcaagtcctactccataactgcagagcatggtgtctgtggtatagcttcccaggtgctgcagccaattagaactccacatgtacagaatcactgttactcagctcctgagtctgtaggccactccacatccctttccttattgaaaaacacatccaagcagcacaaacacatccaagcaggtaatagcagcagcctgaatgcagaacctgggacccggtgaccccactcccttcaggtcccctggggctccagcagctggattgcaaagggaggtggggcccaaaactctgcccactgcagatgaactttgaacaggcacataccgccagatcttccatccagagcagctcatcacaggcaaggaagatgctgccaataactatgcctggggccactacaccattgggaaggagttcatcgacctgctactggaccggattcggaagctggtgaggaaaggactgagggctggggcagggggaatgaatctggattcctgttgtgaggtagtctggacaccagattggggaaggacagcttcagcctctgggagaaacacacaggatcaggaccaatgaggagaggccctgcactctgatcggggggccaactgtaggttccagcctggagctggtgtcccctgtatctccgaagtggctggcctgatgctaggcagggtgtccattaaggcaaacatgttgatgggctgcctggccaagctgtggggttccataagcgttcccagaataccaccttgtgttacaaggatgtgggcagaagtccctgtgaaaggcagggattcaaagaatgtcagcccaaagcctctgtgattggctttggcttctacgaaggatggggatgaggttcctggattgttgttcttagtagagaaaccctctagaaacatccaaagttaaatcagcggggcatgggtgtgatggtgggtggagttggcaagttatgacgacaagatgagggagccctggagtcctgtgcactggtcagcctagacagccaactccacccaccatcatacccctcttttccagcatacaacagagctctgtgttaagggcctcaggagatttcagaggaagagggacagggaggagaaagggtgggccctggacccactctatgaggatctcttttgtgctcttggaaaagtcttccaaggagttcatgaaacttttgggaatttaaaacagcacaagttggttctttcctgtccatcagctgtgctccatgccccacatttcccctccccttccctgtctaggctgaccagtgcacaggacttcagggcttcctggtgttccacagccttggtcggggcactggctctgacgtcacctcattcctgatggagtggctttctgttaactatggcaagaaatccaagctgggattctccatctacccagccccccaggtgtctacagccatggtccagccctacaactctatcctgaccacccacaccaccctggagcactcagactgtgccttcatggtggacaacaaagcaatctatgacatctgccactgcaacctagacatcgagcgcccaacctacaccaacctcaatcgcctcattagccaaattgtctcctccatcacagcttctctgcgctttgacggggccctcaatgtggacctgacagagttccagaccaacctggtgtcctacctcacatccacttccccctggccacctatgcaccagtcatctctgcagaaaaggtataccacgagcagctgttggtggcagagattaccaatgcctgctttgagcctgccaaccagatggtgaagtgtgatccccggcacggcaagtacatggcctgctgcctgctataccatggagatgtggtgcccaaggatgtcaacgctgccattgctgccatcaagaccaagtgcagcattcagtttgtggactggtgccccacaggctttaaggttgatatcaatcaccagcctcccactgtggtgcctgggagtgacctggtaaagtgcaacgtgccatgtgcatgctgagcaacatgacagccatcactatggcctgggcccgcctggaccacaagtttgacctgatgtatgccaagagggcgtttgggcactgatatgtgggtgagggcatggaggagggtgagttctccaaggcccatgaggatatgactgccctggagaaggattacaaggaggtgggcatggatagtgtggagtggggggaagaaaagataggggggatgaatactaggggaatactgtgtgtctgtcctacataaagtgctgtggccttattgtctcacgaatgtctttttctctgggggaaaaccatggggggagggcttcttctccatgagagataggaacgctggtgtcttagcctctattccccagaaagcagatctgattttagatttcattatagagtgcaattacagcaaatagaatgggggccaagggaagtaaggcacagaaggaggaaaaattcaccctagagaaaatgcagctgaataaatggcatctcagaaccatccttgggtgagtgggcaggtgagggctgggggtggggtttatgcactggctctattcttccactagttaaacttttgccccatcaagcattaattcccctgcactggtggattgcacacacttgggctgtagagtcatcaggaaaccctgggcgaggaggaggtgctattaagttgcacatatgtgaagtcagtggaaccccacatggagctgcaacaagagcccggtgaggccaggaggatccgaagtgatccttaaagtaatctagtgcccactagcccatcctgcgatctggaggcttgtcttctccaggcaggaggttggggtaatagagagccctgacactggagttggttgaggcagaagagtggtgcagtggctgccacacagggagaatggcttgtaagggtaggaggcttacctcccagtaatctctgtcaacactcaccacttttttttttttttttttgatggagttttgctcttgttgtccaggctggagtgcaatggcacgatctcggctcactgcaacccccgcctcctgggttcaagctattctcctgcctcagcctcccaagtagctgagattacaggcatgcaccaccaggcctggctaattttatgtttttagtcgagacagggtttcaccatgttggtcaggctggtctccaactcctgaccttgggtgatccaccagcctcagcctcccaaagtgctgggattacaggggtgagttaccatgcccagccctgacactcaccactttttgataaagacagttgaccttttaacagtcctgtggcatcatgcacacacagcttcccacccccacttccaaacaaatggcaaattttaaatcctgagactgagtgaggcaggagaatcgcttgagaccaggaggcagaatttgcagtgagctgagatagtgccactgtactccagcctaggtgacagagccagactccatctcaaaaaaataaacataaataaataaaaaaatacaatacaataatatttttgtaaggacaggatctcaccatgttgccctggctggtctcgaactcctgggctcaagtaattctcccaccttggcctcccaaagtgttgagattacaagcatgagccaccatgccttgctaaaagggctgacttttaaatctccatatatttgacttatgcgtctttccatcaactggtttcaaacttgggaagggaaaaggtgttactctgggagcccttcacaccccaagaaatagccatcatttagtgagcatctactatgtgctaggtcctgtatccataagatcttgtttaattctgaggttaatacagttattacacccactggaacagaagctctcagacaggccttggactgtttttcattgttctactctcaacaccccagtgttgcccggcatattagatgattaacacttgttggatgaacttgttcaatgaacacctattttatagatgtggagactgagactcaaagactcgcccaaggtggtaaatggaggagttgggattcaaacccaggttagcctgcaccaaatcatatgttgctcccccacctttttcttaggtgccctcacttcctgctcacagtggttccaggcagccctccagacaccacctcttctcagcctgccaggtcccgagtgcccagacagtgactcaggtgcctcaggggcagggagtgggtgacgcttcacaatgccctgcccaggctctgggaaggagggcatcgatgtagaggggagagtcccagcttctgggtctgaatgggggtagaggcttctttggggccagattttggggctatcagtgccctttggaaaacatcccccaacatctcctaggaggtggtgagggcctgggagaggccaggattgggggtggggagggaggtgagctcttcacctgccaagacggctagggatcgagagaggcagctcgtctcccttcctgtctgctgaaccagccagcccaccctgggcagctatatagccatctccctgaggtcttcctgctagtaatactctgctggcaggccctggcaggcctgggttggactgggtatggctgtggagaggtggcaacccagacctcctgaggcagctaggagcaccacccagcctggctcctggggactccctcagtgcaggggaaatgctttcatccctgatgattctgagccaaagtacaattgcctccttcaggcagacaaaagagacaggtttccaagctcagattctacccaacaaatttattccctgggctctgatgtgtcaggaacacgcctggcttcaaagctgtgttgtcaccattctctccttctggaacgccacctccccctgcttgtctcaatgttgccattccttccagcttaggtcacagccatccagaacctacccagccccagggagctctccctcttctgaattctttcagcacctacctcggtctctatttttcatttggcacttggtgtgggctgccttgtatgatatcacttggcttcttgtcaatgtcttatttccccaactcaatttttaacaattagtatgaatttgaacagttattaggtgcatatgcttcagaattcaaaaagtatcagagagatttaggaacaagaaaaataagtctctttcattttgttcccctcttggcagccaccactgttaatgtttttgttagtgtttccttccagagatgtctacatatatataggttgaatatcccttatcggaaatgcttgggaacagaagtgtttaggatttcagattttttcagattttgaaatattcgcatatacataatgaaatatcttggggctgaaacccaagtctaaatacgaaatttacttatgtttcatatacacctgatacacattgcatgaagggaatgttgtataatgttttaaataatttttttgttttgttttgttttgttttgttttttgagatggagtttcactattgttgcccaggctggagtgcaatagcgtgatcttggcttactgcacctccaccttccaagttcaagtgattctcctgcctcagcctcccaggtagctgggattacacgtgcctaccaccatgccagctaatttttgtatttttagtagagacagggtttcaccatgttggccaggctggtctcaaactcctgacctcaggtgatcctccagacttcaggtgatcctcccgcctcggcctcccaaagtgctgggattataggcctgagccattgagcccagcctatgttttaaataattttgtgcatgaaacagtttgtgtatataaggtcaggtatggaattttccacttgtggcatcatgtcaggtactcaaaaagttttgaatttttgaacatttcacattttgggtttttggagtagggatgctccatctgtactaccatgcttgtatgcacatttagtatacactttgttctacaccttgttttttcagttaataataaatctggaagatggtccatatgaatactgttagctatgcctcattctatttggtcacaatataatattccatcgtatagcataccaacacttgttttaccagtctgctattaacgggtatttagattgtttccaatcttttgctattaaaaagaatgctgcaacccttgtatgtattttttttgcacatatatatgaccatacattcttagaattgagatttctgggtcaaagattatgcattttaaatcttgctctctttaaaagtcacaccaggccgggcacggcggctcacgcctgcaatcccagctacttgggaggctgaggcaggagaactgcttgaacccgggaggcagaggttgccgtgagccaagattgcaccattgcactccagcctgggcaataagagtgaaactctgcctcaaaaaaaaaaaaaaaaaaaaagtcacatcaaattacccaccctcccactaccaatctataagaatgcctgtgccctcagccttgcccatacaatgtattcaacttttttcttttttttgtctttgtcaatcatccaataagtgaaacaaagtattttgttagggccatgtgcccgggtgcagtggctctggcctatagtcccagcactttgggaggctgaggcaggaggatcatctgaggccaggagtttgagaccagtctggccaacatggtgaaaccccatctctacaaaaaatacaaaaattagccaggggtggtggcacatgcctgtaatcccagctacttgggaggctgaggcaggggaattgcttgaacctgggaggttgcagtgagccaagatagtgccactgcactggagcctggatgacagagcaagactccatctcaaaaaacaaaaccccaaagtattttgttgtagctttattattattattcttttaaaaattattattatttgagatggagtttcactcttgttgcccaggctggagtgcaatggcacgatcttggctcactgcaacctccgcctcccgggttcaagtgattttcccgtctcagcctgccgagtagctgggattacaggcatgtgccaccacgcctggctactttttgtatttttggtagagacagggtttcaccatattggccaggctgatctgaaactcctgacctcaggtgatctacccgccttggcctcccaaagtgctgggattacaggcatgagccaccatgcctggcctgtcgtagctttagtttacagtttttttgtgaatgagattgagcatcttttcatttgtttaaaagccagtatttcctcttctgtgagctgcctgtccctttgtccatttaaaaatgtcattgtctttcattagttggcatttctttgtggacaaaggaaattaaacctttgtctgctagatgtgctccatataatttccctcagttgtcatttgtctatgtcctatccccttgagcacagagattggaatttaaacttttttatattctttttcttaatataacaagacatacacggtaggtgctagacaaatgtctgttggcacagcagagtaagaagaaaaaggcagagatctggaaaatttggagtgacttaacccaaccactccttcctcttataccaagtctaacccttagtctttgtgtcagtcaggactcttataaacagcagaagctaactggcaaattgtttcaagtcccctgcccccaacaattatagagatatcggatagcacacagaatcaatgcaagggccagcaaacaagggtcagcaatcagacaggcacctagggaagctgggcagccagtaccacagtcaaggttgggcacaggacagcctgtgtaggagactcctgtcccctccaccctccgcagtgatcctcctactctcgtccctcacctgcggcagtagcgctgacacttcctcctccagacactagaggccgctgttggccccatcgcctccaccgccgccgcagaaatgaattcctaaaccagccttgctattccgtgacttgctccagattcaaagtcccagttggagcatccgattggcggagctcatgtcttctgcctgcaaccccagagccgagtcagggagagcaagcattggggctttgtggcaaatggtggcctgctttccattagggcccttgcgatgggaattccccaaatgtaggcaggaggttctgatggtgggcagccaggaaaccaggacactcacaccaccttcttctctcacgtccgcctcaaacccttctcgttggcgaagtattcctgggtcccccagcctaaagcacttttctggactcacataaccattattgcttgagccaatcacgatgccagcaggaccgcagtaacacctaattcgtaccatgtctcatttgactttcaaacaaccctaggcactacctatatttagtgagaaaaaaagagtgctcagagattttcccaagtctcacagtaatgccaggttgtactctgtttccaaagcctcgggtttcccagcgggctacactgatgggctggtatcttatcaagttcaagctctgcaaaggcagggcttgggccacattcttctttatacggcctggcagcatcttgaatgcagaaaaatgctcagctaacgcctttggattggcctggatgggatcaagcaggagccagttctggaaggtttcctaactctccaatgaggcctgaacccagggagcattttgaagtggaataggcctactcaggatcagtttgggaagacttgaacctggggaattccgttgtacggccccctttacctcacctcccccaaatgtgtcaaaactgtcaacaagaggtttgcaggtgttcattatttattcatcccacgggtagttttgaacccctacgactgctctaatagaccagtgagaaaaaacacacaattcctgtcctgtgaaatcgacattctagtgggggaggtgaatggtaataaaaaataatcaaaccaataaatgctaatttgtggctctaacaagcctgatgaaggaaatgccacgagatgctgtaaaaggcagttctgacctactcaggaaagccagggcagcctgctgggggacctggggctggagctgggagctgaagaagggggaggagttagaaccgtggtggggggagggagggaagagtctgagtcctcgaggtgggtgagtaagcatggatcatcgctcatgtttataagaaagtgacagaggaacctgggggccgagcggcttgtttgtgggctgccccagcctccgtgcgagcgcttctcgcttggatggaggcggggccgcagtctcccaggtcccagctggggctgacgtcgtcctggtgtgtgcccaaaatagccggctccgccctcttctcccggcagcccctgcaggcccccacccccccaggggacaggcggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggaggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccggtgtgctccgcttccaactgggagcgccttccgccacccggggagggggactgctgcagccacagggtggggctcttggttctttccgcctgactccttctcttctgcagccccaaggaggcccgcctgacgactgaccagttgccatggcatcctactacgagatcctagacgtgccgcgaagtgcgtccgctgatgacatcaagaaggcgtaagtgcctccgtatgcaacagaagacctctcaccctccacccgccaccaccatggggcacttcagagtgacacctgtaggtgtctgagggaaccaggtcgttagaaagcactggggtgcttcttccgagtgacacctgcagggaggaaagagacccctggtagagtacaaggagaacgtccagagagtgaagtagttagttcctctgggagctgcactgtgttatgggttgttctccagttgatcttcccctcctcctcctcctcctcctcctttcccctcccctcccccttccccctagatttgggcattctcaggctgcagtgcaaagatgcagtgcaaagaggctctatgaggaggaggggccggtgtccctgtactcttcgaggccacatgtgccccaacctttgcagccccagtccagtgagccctagggaggggctagggaccctggcattgtatccgcttgtacatgtggtcccagcactggtggcggaggagagagggtggaacttgatgaaaatatcacagcagcggcagccctagcagctggggtggactgggacccgggggtgaaaggacagtgataggctaatgggaaaacaggtcgttcggttcctgggtgggaagtgcctgcatttgtcccccgactctctcctctgcacccactttctgcaggtatcggcgcaaggctctccagtggcacccagacaaaaacccagataataaagagtttgctgagaagaaatttaaggaggtggccgaggcatatgaagtgctgtctgacagtaagggccggggtcaggcaggacccagcacatcaccccctacttcatgccccagctcacattttcttaaagcaatgtctctgccacctagtttcctctgtgcctttttccagcctgacatttaagctcccccctcccacagggacagctcagtgtctgctccccagagtctggtaggagtggctggcatgagacctgaaaggggaaggaagcagggcaggtaactcatgtgagctgagcctcctgcgtgccaggcattggtgggtgtcatctccatgagttctcacagccgtcctatgaggcaggttctatcacccctattttacaggcaaggaaactgaggctgagagaggtgaagtaacttgctcaaggccacgcagagctggaatatgaatccaggtctgcctttttattgattcattcgaaaagtaattcagtgaatggtgacagtgtccggcactcgctgggtgctggggaaactggaggacaagcaggcactgtctttgcccagaggggcagggaagaccaacacctaccaggcacacacacagacacagttacagcttgtgaagagtattccgagggaagaaacagggcaggtggagtgctagggaataatgtgcacttgctttagttctggtggttgtagaaggcctctccgagaaggtgacatttaggctaagccctggtgaataataatgtagtaatcattagctaacatttattgaacactttctatgtgtcaggcactggtaggcagtttacgtggatggtctcatttgatctgtgcaacaaccctgtgcggtaggtgttgtgatgacagccattttccagatgagaagaggccagctgtgtgaaaggctgagttgctgcctaaacctatagcccgtgtcccctgggtcccctgctgtgcctgctttcccccgccaagtgtcagagtgt

SEQ ID NO: 592 - DNA, 50610 bp, Homo sapiens
gggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaaccaatcatcttctgagatttatacagattgctcataattctctcctattttttaaaaacatgctgcagtgaactgctttacactcattttatgactacttctgagaccaagatcccggattatgtaattgttatttacttaaaattctggtaaaatgtagccattatactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacgggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttaacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttctgggtgtaggaagcagagattaccaagcatggttccatagcctagaggagtccagtgtggcctgtgtgtgtttggagacagccaggtagtatcccgtgagatacacactaatatatggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtatttttagtacagatggggtttcgccatgttggccaggctggtcttgaatccctgacctcaagtgatccgcccgcctcggcctcccaaagtactgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcccatgtagactggggttaataatagtagctattgcattaagccactggggaaaggcacaaagataataatgtatgtaaagcccattgcccaggttataataagcactgaatcgacattggctatgattatttttgattaatgaaggggagggggttatggcactggaagattttaagtaggaaaaggacatgatctcatccctgggtcaggtggaggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagctgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctgggacttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagaccccaagttcttctctcaaagccccactccttccccgtcacaaccctaactccttcttctcaaagaccccaatttcttttctcaaagcaccaagcaccactccgtcccccttcccccaccatcatggcctttaactcctttctctcctagtcccccaccccaccccccttttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctggccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgaccctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccactttgcaaaatttctggaaaagtaacctatacccatttcttctgcttccttatttctcactcattctttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactctgagatcaccagtaacctctaattgtcaaaccatcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggcttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcaggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattctttttttttttaattctaaaaaaaaaaaaaaaaaaaaaagagtatgtgttttgtcatcagacttaagttttacttctttgaactagaaatttaacttcttcaagtctcagttttttttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcactgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagatatcataattcctctctttctttgtggtaaacatgaaggtgtaccatccagttctacctccaaagaaagacttcctgttggccgggcatgatggttcacgcttgtaatcgcagcactttgggaggccgaggtggggggatcacctgaggtcaggagttggagaccagcctggccaacatggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgccactgcactccagcctgggcaacaagagcaaaattccatctcaaataaataaataaatacataaataagaaaaaaaagacttgccgttcagctatagggggaatagccagcagatagcttccgcttgcttcagttctttcaatgtctgcctcagctgtagaggacagtcctgcacaagatcatgcccatcccagggctgccctcactcggtgcctaagcaaggcaggggtataaaagttcggtcattttggccaactgcaggacaactctgagaataggttggattgacaagggctagccagggctggaaatattcactccagagctccctgccagggaggctgggtctttgtcagatctgcattgccgtttgacttctctcttagctcagccctacttcttccccctggtaagcatcttgcacctcaaactctgtctcagcctctgcttccagataacccaacttgtgtgtgtgtgtctctctctctttcaaaattgagaaattttctcaatcttgtctggaccatggcagcagcctcctcctaagaaattgcctctaatttctccatattttaattcatcttctacatggcagtaagaaacacagatctaattgtgtcattattccgttttttgttgttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttaatttaattttattttattttattttgagatggagtctcactctgtcacccaggctggagtaaagtggtgcgatctctgctcactgcaacctccacctcctgggttcaagctattctcctacctcagcctcccaagtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccggcgtgagccactgtgcccggcccctcaaattttattttctaccatttctctttagccactgtgccttagattatttattttaaaagcatatttttaaatgacggaagtggtacaacaacagcaataacagagaagtttacaaagaaatttcataaaggaaaaacggaacgcctcctgctttctcattctccccaaatccttactccagaggtatgctaagattattagttgcaagcaacagaaaccaattctgccaacttaaggggaaaataagtatattggaaggttattaagtaatcctcagagttgatgggaaagccagataatcaagctcagaaagtagaaccagggaccacagccaaagtcacaccacaggaatggtattaaggatgccacagctggaagcactacctccatcaccaatgctgctgccatattaaaggaattctcctctgaccctgtgtctttacatcatttgttcaagagtcaatatcctgagtggaagcagccaaatgaccaagccttgatcatgttgcttttgccttagctgcaagtgcaggggggaaaaggaaaactttagatacctttgacttctcttgtgggaggtgagaacctgtctcccattaagactcacacagaggaagagatttcagatgctgggcaaccaaaacaggtacaggtgattttaaagaattgatgcaaatgagaagcctggagatcagtagccactgctgtatttactaactctacatatattatcttttttttgagacagactcttggtctgttgcccaggctggaattggtggcacgatcatggctcactgcagcttcaacctcctgggctcaaaaaacagaacaaaagaaaaataaaatagaaaagcaaaaacaacaaaaacccataaatgttcactatatctcacatcattaatttatttactcgtttaataaatgtttgtcagaaacttccatatagaaggctttatgttatgtactttggaagacacaaaacgattaggatatgatccttctcaaggagcccagtcttttcttgggaagataaaacatacaaaagagaacaacacaaggcaagatgcattgtataactagaagaaacacacaaataaaaatgtgatgttatgtggccgggcatggtggctcacgcctgtaatcccagcactttgggaggctgaggtgggcagttcacctgaggtcaggtgttcgagaccagcctggccaacatggtgaaaccgtctctactaaatatacaaaaattagccaggcatggtggcacgtgcctgtagttccagctactcaggaggctaaggaaggagagtagcttgcacccaggaggcagatgttgcagtgagttgagatcgtgccactgcactccagcctgggcgacagagcgagactccgtctcaaaaaaaaaaaaaaaaaaaaaaaaaaggaaagaaagaaagaaaaatgttatgctctgatttactcttgtagctatcatttacatattgctatatagtttttggaattctgtaacttgcgtttatcatttaatactctctttggtcttgtaagatagatataatcattttagattaggagacatgtttagggagaataagaaagttaataactgatatggtttggatgttttgtccctccaaatctcatgttggaacgtgacctccattgttagagatgggcataatgggaggtgtttgggtcatgggggcagatccctcatgaatggcttaacaccatcctttagtgttgagtgagttcttgttcagttagattacacatgagatctcgttgtttaaaaggatctgagacctcccctcctctttcttgcttccttctgtctcatcttatatgcctgctccccctttgccttccaacatgattgaaagcttcctgaggcctcaccagaagaagatgctggtgccatgcttcctgtacatcctgcagaagtgtgagtcaaaaataaacctcttttcttttataaattagccacttgcaggtattccagtatagcagcacaagaattgactaatatagtatcagagctaggattcaaacccgtgcctttgtgttctaggatttatgctttctctcctctactaaaactgcaggaatcagaggaatctaggggagaaacatggtatttgtgaattggtgagatatgaccatgcccagataggaaagatagacagaacagattcaataatgaaaataggaaaaagcagagtaaattttagacatttcttaaagaagatacaccagtggccaataagcacatgaaaagatgcccaacatcgttatagtcattatggaaatgcaaatcaaaaccatgagataccacttcataccatcaagaatggctataggaggatggatagaatcaatattgtgaaaatgaccatactgccaaaagcaatctacaaattcacgcagtccccatcaaaataccaccatcattcttcacagagttagaaaaaacaattctaaaattcatatggaatcaaaaaagagcccacatggccaaagcaagagtaagcaaaaagaacaaatctggaggcatcacactacctgatttcaaattatactataaggccatagtcaccaaaacagcatgatactggtataaaaataggcacatagaccaatggaacagaatagagaacccagaaataaacccaaatacttatagccaactgatctttgacaaagcaaacaaaaacataaaagtggggaaaggacacccttttcaacaaatggtgctgggataattggttagccacaggtagaagaacgaaactggatcctcatcttttaccttatacaaaaatcaactcaagatggattgaggagctgggcgtggtggctcacgcctgtaatcctagcactttgggaggccgaggcgggcagatcacgaggtcaggagattgagaccatcctggctaacacggtgaaacccatctctactaaaaatacaaaaaattagctgggcgtggtggcgggcgcctgtagtcccagccactcagaaggctgaggcaggagaatggcgtgaacccaggaggtggagcttgcagtgagctgagatgacgccactgcactccagcctgggtgacagagcgagactgtgagactctgtcacaaaaaagaaaaaaacacaagatggattaaggacctaaacccaagacctgaaactgtaaaatttctagaagataacattggaaaaacccttctagacattggcttagccaaagatttcaagacaaaaaaaccaaaagcagttgcaatataaataaaggtaaatagctgggacctaattaaaccaaagagcttttgcacggcaaaaggaacagtcagcagagtaaacagacaactcacagagtgggagaaaatcttcacaatctatacatctgacaaaggactaatatccagaatctacaatgaactcaaacgaatcagtaagacaaaaaaaaaaaaaaaaaaaatcaatcccaacaaaaagtgggctaaggagatgaatagacaattctcaaaagaagatatacaaatagccaacaaacatgaaaaaatgctcaacattactaatgatcaggaaaatgcaaatcaaaaccacaaagcgataccaccgtactcccataagaatggccataatcaaataataaaataatagtagacgttgacgtggatgcagcaatcagggaacacttctacactgctggtgggaatgtaaactagtacagctgctatggaaaacagcgtggagattccttaaaaaactaaaagtagagctaccatttgatccagcaatcccactactgggtatctaccccgaggaaaagaagtcattattcaaaaaagatacttgcacacgcaagtttatagcagcacaattcaccattgcaaaatcgtggaacaaacccaaatgcccatcaatcaatgaatggataaagaaactctggtatatatatatgatggagtactactcagccataaaaggaatgaattaacagcatttgcaatgacctggaggagattagagactattattctaagtgaagtaactcaggaatggaaaaccaaacatcatatgttctcactgatatgtgggagctaagcgatgaggatgcaaaggtataagaatgatacaatggactttggggacttggggcaaagagtgggaggggggtgagggataaaagactacaaatatggtgcattgtgtactgcttgggtgacgggtgccacaaatctccaccaaacaacttactcatgtaaccaaatgccacctgtacctcgataacttatggaaaaataaaattttaaaaagaatggctataggaaaaaagacagacaataacaagtgttggcaagaatgtgaagaaattggaaccctcatacattgctggtggcaatggtatagcactttggaaaacaatttgacagttcttcaaaaagttaaacatagagttattgtgtggcccagcaagtccgctcctagtatatgcccaagaaaattgaaacatacatccatgcaaatacttgtacatgaatgttcacagaagcattattcctaatagccaaaaatggtaataatccaaatgtctgttaattgatggagaaacaaaatgtagtattttaatacaatggaatattatctagccatgaaaatgaggtactgacacatgttacaacacggatgagccttaaaaacatgataagtagtccgggagcagtggctctcgcctgcagtcacaacactttgggaggccaaggcgggtggatcatgagatcgggagttcaagaccagcctgaccaacatggagaaaccccgcctcttctaaaaatagaaaattagccgggcatggtagcacatgcctgtaatcccagctactcgggaggctgaggcgggagaatcacttaagcccaggaggctgaggttgcggtgagccaagatcgcgccattgcactccagcctgggcaacaagagtgaaactccatctcaaaaaaaaaaaaaaaaaaaatgataagtaaaagaagccagtcacaaagaaccaggtattatatgattcaacacacgtgaaacatccagaataggcaatctgaccaggcacagtggctcatgcctgtaatcccagcaatttgggaggccaaggcaggtggatcacaaggtcaggagatcgagaccatccttgctaacatggtgaaaccctgtctctactaaaaaaaaaagtacaaaaaagagctgggcatggtggcacgtgcctataatcccagttactcgagaggctaaggcaggagaatggcgtgaacctgggaggcggaggttgcagtgagtggagattgcgccactgcactccagcctgggcaacaaagcaagactctgtctcaaaaaaaaaaaagaaaaaaaaatagcaatagctgtttaagtcagtggcctgcaaaacatgttaacaattaggtcaattccttctttgcgcttcctcaatccatagtttgatctatcttcctccaaatctgctctgtcactcaggctggagtgcagtggtgtgatcccagttcactgcagtctccatctcgcaggctcaaacgatcctcccacctcagcttcctgagtagctgggactacaggcatgcacctccaagcctgcctaaatttgttttgtttgtttgtttgtttgttttgtagagtcagggtttcaccatgttgcccaggctcgaattcctgaactgaagtgatccacctacctgggcctgccaaagtgctgggattacaggcatgagccaccacacctggcctgaacacgcttatactaatggtgaaataatgttgggtagctgtaagtggcttgcccaaagttccacagtgatgtggtacaagaactggcactagagcttgggacttctgacttctgatcctgagctattgctgctacatcattccatgagaggcattaggaatcataggttaaagaggtaaggtactacttggagggattctctgaaaatttttgcccatgtccaaaagcaggagaggtaagtaatcagggaaacagtgggatgaataactctgaccgtttagggagaagatatgatcctcatttccaggagtttctacacagggtgaagagtgaatggaaggttcatctgcttatgcttacgtatgtgaatacatgttcatagctacatgaccttagataagtcagtgcccctctctgagagggagtttgtaatctctgagatatctaaggtatctcccagctctgataactaggattctacattcctaagtccagatggctgacaggacaattgtaaaggtcctagaagttccattcctctttttgggaatgatcttagaatgtttggcttgggtcagttacgtggcagccagactattagagctccagttggagtttacaagagaaataaacaaatctgaaataaaggtaaacaaatgactccctggcatattctaaaagtatccttctgggtggcttggcttactggattccccatcttttaattcagttcaacacgtgtgccttgattttatatctctgccaggtggcctgaggtttaggttttggaccgcattctttttccaactcagccaactgttgctgaggactgttttatgcaaagaattgtgctaactgctagcagggatgcaaaagtgggtaaaacatgatctctgcccaggaactgatagtctagaaggagaagcatacaaagcagtttattttaacacagaaggaatgaaaagattcaaagtaattataagctatgtactgaaagaaagagatctgggaaggctacacagaggccatagatttcatctggggcttgaagaagagaattacagtaggtgaaaaggggaaagatgtttctcctttcctagactaagatctttgagggcagagattacatcttatttatctctgtgttcctgatacccaacatagtgcctggcacaaggaaagagtccaatacatgtgttttgaatcaatgaataatgagtggattctagactgatataatagcacaaagacaaagtggataaaagtgcaccttatgtttggggaatgctaaatggtctgatgtggttgctccgaatattggttatataaggaaatgttatgggaaatcaaattttagtaccagattaagaatgccatgctaagaagttatacttagtctataggcaatagttaactatttactcctctaggacaaaatacccttgggttgtgggaagtcagggaccccgaacagagggacctgctgaagccgtgacagaagaacataaattgtgaagatttcatggacatttatcacttccccaatcaatactcttataatttcctatgcctgtctttactttaatctcttaatcccatcatcttcataagctgaggatgtatgtcacctcaggaccctgtgatgattgcgttaactgcacaagttgttcataaagcatgtgtgtttgaacaatttgaaatctgggcaccttgaaaaaagaacaggataacagcgacgttcagggaacaagggagataaccattaggtctgactgcctgggagctgggcaggacagagccatatttctcttattaccaaaaatgggtaagagaaatatagctgaattctttccccagtaaggaatattaataattaacagccctgggaaaagaacgcattccgggggggggcctctaaaatggccactctggaggggtgtctgccttatgcagttacagataagggatgaaacacaccctggtctcctgcagcgtccccagacttgctaggattaggaaattccagcctggcgaattctagtcagaccggttctctgctcttgaaccctgttgtttatcaatgacaatgcatgcacagtgggacatggaacttcattaataattctagtttcgccctgaccttgtgatctcgccctgaccttctgccttgtgatcttttgttgcccttgaaacaagtgatctctgtgacccacaccctattcgtacactccctcccctttgaaaattgctaataaaaacttgctggttttacggctcagggggcatcacggaacctgccgacatgtgatgtctcccccggacacccagctttaaaatttctctcttttgtactctttccctttatttctcagaccagccaacacttagggaaaatagaaaagaacccacgttgaaatatcgggggctggttcccccaatacccttgttcatctttgtatccttagtatctacaacagtgccaggaatttagaagttagtcaataaatggctggatgaatgaatgaattgaagagttttgaggaaggaaattatttcatccaatctgcaccttactttactgataataatccctcgcctttttgtacaattttgtagtcacagaaacattttatcctattatgtcatgaaaaattttattgatatgctcaaaaagcttattaggaaagaaaggcagatattattatcatttcctatagatgttattattctcatttcctggcaacgttattattctcacacccagtaaaaagaaaccaaaactctatttcttctaatatctcttggtatatccgatgatctgttgtatgtgtactggcatataacagggttctcatgggtagccttaatcttgcatcacactcactataatcaggatttctacatatcccaaaaaatagatccaactcgcaatgcagggatattgtactgattacttcatggggatcctggctgtaccataccccacacagcagaagcttaatcaattcttagacatttctgttctttttcttaagcttgatctctctcaacatcaacgaacttatctctcttccttctctttcctctcacaaccttgcccccttttcccacccaaacaaaaaacaaaacccattattttattaagcctttcatttttcagtatgtttatttttctcagcaaaacaaaagccctgtagtttttcttatttccttaaacatggtgttttatttcatccaaatgcaagtgaagaggagattagatttggtttgtggaattccagggaacagattaatgaatgagaggaagtcagagagaaataaatgttagtttaatgtaactttctgacccagcaattcaataatggaactggctgtttcacagagtagtgaactccctgttactggaagtatttggcatgtcaagtccaacttctgacctctaaaaccgcatgtgaccgtcctacatatgttcaaagatgatggtcctgttctcctaaatcttttcttctttttttgagacagagtctcgctccgtcgccaggctggagtgcagtggtgtgatctcggcccactgcaatgtctgcctcctcagttaaagtgattctcctgcctcagcctcctgagtagttgggactacaggcacgtaccaccaggcccagctaattttcatatttttagtagagacagggtttcaccatgttggccaggatggtctcgatctcttgacctcatgatccacctacctcagcatcccaaagtgctgggattacaggctgtgaaccaccgtgcccagcaatcttttcttctccagattaaacatcttactttcttcaagggttccttatttgatgtggcagttcagtaacctgctattgttcttctggacttgttacaatttgtcaatttctcatgcatttatttaaaaaaatttattgagtcgggtcactagaattactaaataagaaaaagaaaattattgagtgacttctatggttcagacgctgttttaggacgtgggaatagagcaatatagcagagaacaaaaacaaagtctgtcttagaagctacagtttactgggagggacagaccctaaacaaataatttttttttaatgtcagagataattagtaggaaataggtagaaaaataaggaaggtcgaagggagaataactgagttgctgttttagacagcataatcagggcaggcctctggaataagatgacagttgagcagagatatgaaggaagtgcaagagtggccaggggaagaacaagccaatttagatagaccgaacaagtgcaaaagctctgaggagtaagcttggtttatttcatgaacaaggaggccagtttatctgaagtggtacaggcaaagagaagagaaagagcaggaggcaaataaccgagggcctaataagccaattatctgtactttgctatttgttctgagtgagatggaaaggcattggaggctttcgagaagaggactgacgtgatttgacttgcatttgaaaagcatcactatggctaccatggggggaaacaaagtttaaaaggcaaagaaatactcagggacctccaaggatactcatacattcctgttaggaggcaataatatgggtgaaaaatgatggtggcaaggacaagggtgataccactacttacccattacccatcagaatagtcagaaagaaaaagacaaacaaggaaggaaagaaaagacagtattggcaaggatacaggccaattagaactttcctacactgctgttggtaaggtaaattgatatgaaacaaccactgtttagaaaaccgcagtatctactaaagttgaacatctgcctcctaggcatatgcctaacagaaacgtttacctatgttcactgaaagacatatacaagattagtcatagctgtaagaattaaagaaagaagagagaaacacgaagggcggctcgacagtcaacagggacaggtttattctgaataaacttgagtggggcagctggccaagttaggtcagagccacactctcttacagactaagtgtttttaaggattcagggtgggagaatttatcagaggcttggactgcttctgtgtttctttgttgtgcttatctgggagggaaagttgtgtgtctgttcccatacatctttctgcagctgcaggcatatcccccgggttgcttttagcttccctatcttagtgcacctgaagggaaaggaatgtgcttattagggcctactgttttactgggagccatcgtatgagggtgaagtttggcagttacccaggagactttccccccacctccctctgtacccaagctgtcttatctatgttttactgtctgctctttctatttgtacttagaagagagtgatttccttgaaatgcacgaggctagaaagggagctggaacttaaagtggcagtgtttgttcgagatgacagtgctcctgctctgtcaatagcagtattctttgtaatatccccaactaaaaagtacccaaacaccatcaagaatagaataatgaaacaaattatactatatttacataatggaatatacaacgagagtagaaaaacttaaactacaagtcttaatataagtgaatgtcacaaatataatattgatcaaaagaagccaaacacaaaaaagtataaactatatgattacatttatataaatttcaaagacacacagaactaacctgtggtgttagaagccaggatattggttacatttgggaagctaatgattagaagggagacatgagggcttctgaggcaatgccctgtttctttctttcttttttttttttttttaagatggagtctcgctctgtcaccaggctggagtgtagtggcgcaatctcggctcactgcaacctccacctcccaggttcaagccattctcctgccacagccccccgagtagttgggcctacaggcgcatgccaccacgcccagctaatttttgtacttttagtagagacggggtttcactgtgttggccaggatggtcttgatctcttgacctcgtgatctgcctgcctcagcctcccagagtgctgggattacaggcatgagccaccgcacctggcctgccctgtttcttaatctggatgctggctatatcaataggctcactttgtgaacattcactaagttgtacatttataatttgagcactttcctgtatcagtgttatgcctcaataaagtttacattacaaaggaatgactcagaggttttgatctgtgcaactggaggctataattgacatttattgaaatggggaagctatagaagaagcaggttttggtgggaaatgcattcattatgtacatactacatttgatatttattagacatccaagttgaaatgctgatagaatgcagttggtatacaagtctgcagttgagggaaatgtctaggctgaagacctaaatttgagagctcactatatagataacatgtaaactcataaagctggatgggatcacctaaggaatagtctagacagagaaaacattcaagtactaaaccctgaggacgccccaacatttaaaggctggaaattgaggagaaaccagtaaagaaaactgagtagccagtgaggtgtgataagagctgagagagtggaatctcagaagccaggtgaaaaaagtgttctaaggaggaagtaaccactgtaacagatacagcagatagtggaataaggtaaggactgatcatcggttattgatggagatcactggagaccttgataaacagcagttttggtggtgtggtagggacaaaagcctaattagaatgagctcaagaaacaaactaatttgagacagtgactataaataactcttttgaggagtttggtttgttttacagaagaacagagaagtaagatattaaaaagaatattaattaaggatatgaagcagtgttgggttaagtaactaaggaggcttatgggatcaagaaaagttttttctcttaataaggtagataataaagtatgtttgtacacttacagggataatcaatagagagggaaaatttgatgacacaagaaaaagagagggcagtggctggagtgatgtcctggagcaggttataaaagaggttagactccaaggcacaaatggagagaccaacttagctaagatcatggacagttcctctagggaggaaagagctagagaaagggatcccttaaatctgtacgtgagccaagagaaattgcaagctcactaccaagttgcacatgtgcttggtaaaaagaaagcttggtaatggctttgataactcaactgtaatataaatcaccatctgactgtcagactaaccccagagtggcatggggtagattcaaacagcctagcaaagactctgaaaatgaactgacactgcaaccacccacagcaggtgagacaaagcttgtagtctgaaactaattgagttatttgcctgctaaaataaactagtcaccatccagataatttaaacaggactcagagtcccacaatctaacactcaagatgggcaagatacaatccaaaattacttaatatacaaagaaccaagaaactgataaatgtttaaaggaaaagaaaacaaatagatgctaatccccaaattatttagatgttagaattatctgacaaaaactttaaagtagctattataaccatcccccatgaggtaaaagttaaacatccttgaaataaatagaaaggtagaagttcttagcagagaaatagaaattatgaaaaagaaccaaatagaaattatgtgaagtaaaaatatttgctgcagagctcattagtagaatggagataacagatggatgaatgaatgagtgaatttgaagatagatcgatataaattattcaatataaagatcatagagaaaaaaatattttaaaaatgaacagtctacagatataccatcctgaatgcacctaatcttgtctaatttttgaagctaggcagggtcaggcctggttaggatttggagggagaccacctgggaatactgggtaatgtaggctgtcaattaaaaaaatgtttttaaacaatcagacacctactatgtaccgataaaattttgtaataaaaaaattcaaaaagtaaacgagaataaataagaataaagaatgtgatgttggccaggagtggtggctcacacttgtaatcctagcactttggaaggccaaggtgggtggatcacctgaggtcacgagtttgagaccagcctggtcaacatcatgaaaccccatctctactaaaaacacaaaaattagccaggtgtggtggtgcttgcctataatcccagctactcgggaggctgaggcaggagaatcacttgaactggggaggcagagattgcagtgagctgagattgcaccattgcactctagcttgagtgacagagcaagagtctgtctcaaaaaaaaaaaaaaaaagaaaaagaaaagaaagaaagaaagaaaaagaacatgatgttttagatatatattaaaaatagtctgggcacagtggctcatgcctgtaagctcagcactttgggaggcagaggtgagcagactgcctgagctcaggagttcgagaccagcctgggcaacatggtgagaccctatctctactaaaaatacaaaaaattagcacagtgtggtagcatgcacctgtagtcccagctactcaggaggctgaggcaggagaatcgcttgaacccaggaggcagaggttgcagtgagccaggattgggccactgcactccagcctgggcaacagagtgagactgcctccaaaaaaaaaaaaaaaaaaaaaaaaaaattaacagagcctcagatacctgtggaaaaatatcaaaagctctaatattggtgtcatcaatatttctgaaatagaggagaaagagactgatgtggaaaagtatttgaagaaatgatggctgaaaacttcataaatttggttaaagatacaaatttacagaattgtaaagctcagtgaaccccaaaaggataaaagcaatgaaaaccccacccaccctaatcaaacttctgaaaaccaaatattaggaaaaaaattttaagagtagccaccaaaaaatcacatgttacatatgggggaacaataattcttatgactgtagatttttcatcagagaccatggaagccagaagacaatggaataacacctttaaagtgctgaaagaaaagaactgtcaacttgaaattttctatctagtgaatattccctttgagaataaaagtgaaataaaaacattctcagataaagaaagcctaaaagaatttgtctccagaacacctgttctgaaagaaatgctaatagaagccaaagtgaaataataccaaaaggaaacttggaactacagaaatgaaggaagagcaacagaattggtatatatctggataaagttaggttatttttctctccttacataaagttatttatgatcattgaaagaaaaaattataacacagtctaggagagtttcaatgtatgtagatgtcatggataggacaattataaacaacagggggaaggtaaagggacccatatacaggcatacctcattttattcattttcccatcgtgttttgtagatattgtgattttacagattgaaggtttatggggcaagtctatcagtgccatttttccaacagtatatgttcacttcctgtctcttgtatcacattctggtaattcttgcagtatttcaaacttgttttttcttttgtagagacaaggtctcactatgttgaccaggctggtcttgaactcctggcctcaagtgatcctctgcccttggcctcccaaagtgctaggattacagatgtgagccatcgaacttagcccaaactttttcattattattatatctgatgtggtgatctgtgatcagtgatcttggatgttactattgtaattgttttggggtgtcacaaatcacacctatataagatggcaaacctatagttgataaatgtagtatgtgtctggctgctccactgaccacctgttccctcacctttctccctcttcttggccctccctattctgtgaggcaatatacattgaaattaggccaatgaataaccctacaatggcctctaaatgttcaagtgaaaagaagagtcacgtctgtgtgcggtggctcatgcctgtaatcccagcactttgggaggccgaggtgggcggatcacaaggtcaggagttcgagactagcctggccaacatggtgaaaccccatctctactaaaaatacaaaaattagcctggcatggtggcagatgcctgtaatcccagctactcaggaggctgaggcaggagaattgcttgaacccaggaggcaggggtcacagtgagccgagatcgcgccactgcactccagcctgggggacagagcaagactccgtctcaaaaaaaaaaaaaaagaaaagaagagtcacatacatctctcactttaaatcaaaatcatgatatgattaagcttagtgaggaatgtacatcaaaagactagataggtcaaaagctaggcctcttacaccaaatggttagccgagttgtaaatgcaaagtaaaagttctcaaagaaaattaaggccaggcgcggtggctcacacctgtaatcccagcactttgggaggccaaggcaggtggatcacgaggtcaggagattgaggccatcctggctaacgtggtgaaaccccatctctactaaaaaaaaaaaaatacaaaaaattagctgggcatagtagcgggtgcctgtagttccagctactcgggaggctgaggcaggagaatggcgtgaaccagggaggtggagcttgcagtgagctgagattgtgccactgcactccagcctgggtgacagagtgagactctgtctcaaaaaaaaaaattaaaagtgctactccggtgaacacatgaatgataaagtgaaacagtcttaatgcttatacagagaaagttgtagaggtctggatagaagattaaacaagccacaacattcccttaagccaaaacttaatctagatcaaatccctaactctctttaattttatgaaggctgagagaggtgaggaagttgcagaagaaaagtttgaaggtagcataagttggctcctgaggtttagggaaagaagccatctccagaacataaaagtacaaggtgaagcagcaagtgctgatgcggaagctgcatcaagttctacagaagatcgagctaagatcactgatgaaggtggctacactaaacaacacattttccatgtaggcaaaacagtcttctattggaagaagatgccatcaaggactttttttttttttttgagatggagtctcactctgtcacccaggctggtgtgcagtggtgcaatctcagctcactgcaacctccatatgctgggttcaaacaattttcctgcctcagcctcccaagtagttgggactacaggtgtacaccaccatgcctgcctaattttttgtatttttagtagagatggagtttcaccatgctgaccaggctggtctcgaactcctgacctcatgatctgcccgcctcatcctcccaaagtgctgggattacaggcatgagccaccatgcccagccagccacctaggacttttatagctaaagataactcattgcctggattcaaagcttcaaagcacaggctaactctcttactaggggataatgcagctggtgattttaagttgaagccaatgtccatgtaccattatgaaaatcctagggccattaagaatgatgtgaattctctgcctatgctccataaatggaacaacaaagcctggatgacagcatatctgttcatagcatggtttactggatattttaagcctactgttgagacctactgctcaggaaaaaagattcctctcaaaatattactactcattggcaatgcacgtggtcacccaagagccctgatggagatgtacaaggagattcaggttgttttcatgcttgctaacacatcattcattctgcagtccatggatcaaggagtaacttcgattttcaagtcttatttaagaaatacaggccaggtgcagtggctcacgcctgtaatcccagcactttgagaggccgaggtgggcggatcacagggtcgggagttcaagagcagcctggccagcatagtgaaaccctgtctctaataaaaatgcagaaattggccgggcatggtggtgggcgcctgtagtcccagctacttgggaggctgagcaggagaatcgcttgaacctgcgagtcagaggttgcagtgagccaagatcatgccactgcactccagcctgggcaacatagtgagactgtgtctcaaaaaaaaaaaaaaaacatttcataggctagagctgccatagatagtgatttctctggatgatctgggcaaagtaaacaaaaagccttctggaaatgattcaccattctaaatgtcattaagaacagttgtgattcatgggaggaggttaaaaatatcaacattaacagaaatttggaagaagttgattccaaccctcatgaatgactttgagaggttcaagtcttcagtggaggaaggaactgctgatgtagtggaaatagcaagataactagaattaaaagtgaagcctgcaaatgtggctgaattctgtaatctcatgataagactttaattaatgaggagttgcttcttctggataaacaaagaaagtggtttgtcaagatagaatctactcctgttgaagatactgtaaacactgttgaaatgacaacaaaggatttagaatattacataaacttagttgataaagaagcagccagaattgagaggattgactccaattttgaaagaagttctactgtgggtaaaatgctatcaaacaccatcacatgctacagagaaatattttgtggaaggaagagtcaattgatatgcaaactttattgttgtcttattttaagaaattgccacagccactccaatcttcagcaaccaccacccttattagtcagtaatcatgaacactgaggcaagaacctccaccagagaaaagactatgactcaccgaaggctctgatgattgttcagatttttaagcaacaaagtactttttaactaaggtatttacattttagacaaaatgtcattgcataacactgtatgcaatgtctaatgtaattagacataatgttattgcacatttattagactataatatagtataaacacaacttttatttattattgtttttctttttagacgaactctttgctctgtcgcccaagctggagtgcagtagcaatcttggctcactgcaatatgcacctcctgggttccagcgattctcctgcctaagccactttggtagcagggattacaggcatgttgccaccatgcccggctaatttttgtatttttagtagagacggggtttcaccatgttggccaagttggtctcgaactcccaacctcaggtgatccacctgcctcggcctcacaaattgctaagattacaggtgtgagccactgcacccggccttaaacataacttatatatgcactgggaaaccaaaaaccttgtgtgattcactttgttgcaatattcactttactgaagtggtctagaactgaacctgcaatatttccaaggtatgcctgtagttgtgagatgtcagtgttttacttgaagtgttaaaacattgattttaagttgactgttaaaattaggtatgtgtattattatccctagatcaacagctaaaaaaaaaaaaccacaaaagatatagacaaccaatatattaaattggaatataaaacatattcaaataatccaaaatataacaggaaaggggacattgagaggcaaaaaaatggaggagacaagcagaaaaataacaaattgtagaccaaaatccactcttatcaataactacattaaatgtaaatggtctttaaaaatgtaaatggtctaaacacaccaattaaaagacaaagatggctgggtgcggtggctcacgcctgcaatcccagcactttgggaggccgaggtgggctgatcacctgaggtcaggagttcaagaccagcctggccaacatggtgaaaccccacctctactaaaaatacaaaaattagccgggcaaggtggtgcatgcctgtaatcccagctactcgggaggctgaggcatgagaatcgcttgaacctgggaggcggaggttgcagtgcactgagatcatgccattgcattccagcctgggcggcagagcaagattccatttcaaaaaaaaaagacaaagatcatcagattggaaaaagaaaaaaacaagacccaactatatgctattacattttattttatttttacttctcaaatgttaaggaaacctattttaaatataaagatataaatatagggaaattacataatgataaaagggtcaattcaccaagaagataaacactgaaatataatatgcaactaacaaagatccaaaataaatgaagcaaaaattgatagaactaaaagagatatggaaaaatccacagtcataactgggagactcaataagtccattctcaatgactgataaacaaatagatggaaatcaaaaaggatatatcaaacctggataacgttatcaactggtttaatataatggacatttacaaaaaacactctacccaagaacaacagaatacatattctttccaagtgcccacagaacatatacccagatagatcatattctgggtcataaaataaactaacaatttttaataaaaccacataaagcatgttctctggctataccaaaattaaacaagaaataaataatagaaaactcccccagcctaaccaacatggtgaaaccccgtctctactaacaatacaaaaattagctgggcatcgtggcgggtgcctataatcccagctactcgggaggctgaggcaggagaattgcttgaacctgggaggtggaggctgcagtgagctgagatcacgtcattgcattccagtccaggtggtagagcaagattccatttccaaaaaaaaaaaaaagacaaagattatcggattggaaaaagaaaaaaacaagacccgactatatgctatcagcaagaaagctattttattttatttttacttctcaaatgtcttatggtttaaggaaatctattttaaatataaagatataaatatagggaagttacataatgataaaagggtcaattcaccaagaagataaacactgaaatatagtatgcaactaacaaagatccaaaataaatgaagcaaaaattgatagaactaaaagagacatggaaaaatccacagtcataactgggagacttcaataactctgttctcaataactgataaacaaatagatggaaatcaaaaaggatatataaaacctggataacattatcaactggtttaatataacggacatttataaaacactctactcaagagcaacagaatacatattctttccaagtgcccacagaacatatacccagatagatcatattctgggtcataaagtaaactttaacaatttttaataaattaaaaccacacaaggccgggcgtggtggctcacacttgtaatcccagcactttaggaggctgaggcagtggatcacctcaggtcgggagttcaagaccagcctgaccaacatggtgaaaccccatctccactaaaaatacaaaactagccgtgcatggtggcacatgcctgtaatcccagctactcgggaggctgaggcaggagaaccgcttgaacccaggaggcagaggttgtggtgagccgagatcatccacataaatggtgttctctggctataccaaaattaaataagaaatcaataatagaaaactcccccagcctgaccaacatggcaaaaccctgtctctactaaaaatacaaaatgtcattgcataacattgtatgcaatgtctaatgttattagacataatgttattgcacatttattagactataatatagtataaacataacttttatttattattgtttttctttttagacgaactcttgggcgtgatagtgcgcgcctgtaatctcagctattcaggaggctgaggcaggagaattgcttgaatccaggaggtggaggttgcagtgagctgagatcgcaccactgcactccagcctgggtaacagaacaagactctgtctcaaaaaaaaagaaaaaaaagaaaaaaaagagaactctcaaatatttagaaattgttaatatacttctaaataatccatgggtcagagaaaaaatcttaaagtaaatcagaaaatatttgaactgactgaacatcaaaacaaaacatatcaaaatttatgggttgcagctaatgcagcgtgtacaggaacatttatagctttacatgcctatgatagaaaaaagaaaggcctcaaatcatactctaagcttctaccttaagaaactagagaaagaacaaattaaacctaaatcaagcagaagaaaaagaaattagaaaagcagaattcaatgaaattgaaaacagaaaaaaatagagaacaatcaataaaaccaaaagctttgaaaaggtgtacagaattcataaactttttgacagatttaccaaggaaaagaaagagagaagacataaattactaatatcaggaatgaaagaggggatgtcacttcagaccctccagatattaaaaggataataagagaatattacaaacaactctatgctcataagtttgacaacttagaggaaatggaccaatttcttgaaagacacaaattacctaaactcagtccagaagaaacagatcagagaaatagtcctaaatgtactaaagaaaatttaattcatagtttaaaaccttccaatgtagagaagaaaactccaggcccagaaggtttcttttcttttccttccttcctccctccctccctccttccctccctccctccctccttccttccttccttctctcttttctttccttttctcttttcttttctttccttttctttcttttctttgtggcagggactcactcctgttattcaggctggagtacagtggtgcaatcacagctcactgcagccaagacttccacacccagcaaatttttttgtatttttagtagagatgggttttcatcatgttgcccaggctggtctcgaactcctggctcaagcaatctgcctgccttagcttcccaaagtgctgggattacaggcatgcgccaccatgcctggcccccaaatggtttcactgggaaattctaccaaatgttaaagaaagaaatagtatcaattccacacaaactcttccagaaaatcaaaaaaacttagctcattttatgaaggcagcatggtcctgatgccaaaatttgaaaaagataacaagaaaactatagaacaatacttcacatgaacatataccccaaaacttcaacaaactacaaactattagcaaaggaatccagaaatatatatatatttttaaaaaataatacttcactactatgtggagtttatcccaggtaatttaatgctggtgtaacattcaaaaatagccaggcatggtggctcacgcctgtaatcccagcactttgggagggtgaagcgggcagatcacctgaggtcaagagtttgagaccagcctggccaacgtggtgaaaccccgtctctactaaaaatacaaaaattagctgggtatggtggtgtgcactagtagtcccagctacttgggaggctgaggcaggagaattgcttgaacccgggaggtggaagttgcagtgagctgagatcgcaccactgtactccagcttgggggacagagcaagactccatctcaataataataataataataaataaatgagcataattcaccatattggcagactaaggaagaaaaaaacacatgataatcctaactgatgaagaaaatgcattaacaaaatttaaaacccattcatgataaaaaaaaaaaaatctctcagcaaactagagaaggaaacttcgttaatccaaaaatatatatatatattggccgggcgcagtggctcacacctataatcccagcactttgggaggccgaggcaggcggatcacctgaggtccagagttcaagaccagccttaccaacgtggagaaacctcgtctccactaaaaatacaaaattagccgggtgtggtggtgcatgcttgtaatcccagctactcgggaggctgaggcaggagaattgcttgaacctgggaggtggaggttgcagtgagccaagatcatgccattgcactccagcctgggcaacaaggacaaaactctgtctaaatatatatatatatatatatatatatatatatatatgtatatatacacacatatatatgtacatatatacatatatctacatatacatatatacatgtatacatatacatatgtatacatgtatatatgtatatatgtgtatgacctccggtgatcccccccccaacctcggcctcccaaagtgctgggattacaggtgtgagccactgcacttgaccgcaaatcacatttctaacaaaggacttgaatccagaatttattttttaacatttttaaaaaattttattttattttatttttggtagagacaggatttttgtatgttgcccaggctggtctcaaacttctgacctcaagtgatcctcctgctcagcctcccaaagcactaggactacaggcatgagccactgtgcctggcctagaatttataaagaaccctcagtagggcgcagtgcctcatgcctgtaatcccagcactttgggaggctgaggcaggcggatcacgaggtcaggagttcaagaccagcctggccaacatagtgaaacctcgtctctactaaaaatacaaaaaaattagccaggcatggtggcaggcacctgtaatcccagctactcaggagaatgaggcaggacaatcacttgaacccgggaggcagaggttgcagtaagccaagatggcgtcactgcagtccagcctgggcaacagtgtgagactctatctcaaaaaaaaaaaaaaaaaaaaaaactctcaaaactcagaaataagaaaacaaacaattttttaaaaaggcaaaagttttgaacaggcacctcaccagagaagatacatggatggcaaataaatatttgaaaatatgctcaacatcatttgttggtagggaattgcaaattaaaaccacagtaaggtatgtctatacacctattgaaattgaaaaaaatccctgacaataccaattgttggtgagaaggcggaacaactgccactctcataaattactggtgggaaaacaaaatgatacagcccctctaggtttcttataaagttaaacacacacttaccataggctccaacaatccctcctagaaattagcccaagtaaaatgaaaatttatgttcataccaaaacctgtacgtgaatgtttacagaagctttattcataattgccaaaactagaaacaacctaaatattcctcaactgggaagtggagtaacaaactgtggtacatccatacaatacactactactcagcaatgaaaaggaattgactactgatacactcaacaacatggatgaatcttaaatccattatgccaagtgaaagaagccaaattcaaaatacaacatattgtatggttccattttatatgacagtctggaaaagaaaaaactataggaatagagaacatatcagtgttgccagggcttaagggtagggaaggctttgactacaaaggggtaacaaaagggaatttgggaaggtgattaactgttttatttttttgtttgtgtgtggtggtgtttacataattctttgcatttgtcaaaactcacagaactctacaccaaaatgtaaattttactgaatgtaaattacaattaaattatatgtatgcaaatctattatgtgtatgtttgtgtatatatatatatatatatatacacatatgaatatttttaaaagctttttcccctcatattactatcaagtcatatctcacagattttgtatttgtacaattattctttcttgagcctgaaattagttaggactgttttgttttgtttttttcttgagatggagtcttactctgttgcccaggctggagtacagtggtatgatctcggctcactgcaacctctgcctcccaagttcaagtgattctctggcctcagcctcccgagtagctgagactacaggcgctcaccaccacacctggctaattttcatatttttagtagagacggggtttctccatgttggtcaggctggtctcgaactcctgacctcaggtgatctgcctgccttggcctcccaaagtgctgggattacaggtgtgagccaccacgcccggtcaagttaggactgtcttcatctctgttaaccttccatttcctctccttccacaaaacctaaactttattattatttgaaacataatttttgagtaagttattccgtctcaagaaggtccaattcgtgttattgagaatggtaaaataatacactacctgccctgggcactttagtgagaatccatttattgggttaactagcagtgactgtggatggcagtgagcaggcctgggagtggccaggacataggacagatgtgctttgatgggagagaagggaaggaaaagccggcagcacagcgatgggaaactagaggccagaggtagaggtggagggcaatgatcagggagcagagatgacagcatgccaaggacatcctgtgctgacttcacaggctggctctgggcataggccagtctcttcctggagctttcattttctctcttcggaatctgtcaactctctactgcaatctgttccacagtcgtatagccaaaatcctcttgctctgtgtctgtttattcaacaaatatttatcttaactgactctaatcacattgtctcctgtttgtcctgcagtgaagcccttttacatctgcttatctcttttgatccaagggaaggagacttaaccctgacttccagagaaggaaatagtctcagaaaggttaagtcatttatctgaagttgcccttttaatactgagtactggactctctcagtatccgcgtactctgctgccccctaccgtgaacatagcaataggttttaaatcacaaaaacacacagcagaacactacacaacactggaaagactacgacactataaatagtgcttacatttgttcatttagcaaatattcagctggacgtggtggctcacgcctgtaatcccagcactttgggaggccgaggcaggtggatcacttgaggccaggagttcaagaccagcctggccaacatggtgaaaccccacctctaaaaatactaaaattagccgggcatggtggcacgcacctgtaataccagctactcgggaggctgaggcaggagaattgcttgaatccaggaggcggaggctgtagtgagccgagatcacaccactgcactccagcctgggtgatacagcaagactccatccccaaaaaataaataaacaaatattaattgagagcctactatatgccagaaataagcaggtattgtccttgtgttcatggagcttatggtgtagagggggagacagaattacacaaaataattacttaattacagtttgaataaatactatgaagtacaaggtgctatatgagggtatagaataagggtatgtagcctggtctggaggcttagggaaatcttacatgaagtagaattcataggaataaattattggttggctatgggggaggttaaagagacatcaagaatgccttccaggtctctggcatgaacaactgggcagatagagcactgttactaagcaggggaagcctagaggaggaagacattatgaatggaaagaatatgaacttggctttggctttttgcagttcgggaatcccacgagacattaaggtatagatgtggaataagcaatcagattcaggagtttgggagcaaggtctatgctagaaatagaaagttgggagttgttgggatacagattatatttgaaactgtggtcatggatgacatttcttagaaaataatagaaagagtagaaggcttataacttccctgagaaactccagaatttaaaaggtcaactggaagagatggagctagcaaaaacttaggacaaggggccaaggaggggaaaatcaggaatgtgcaatgatgccaaagtcaggggaagtgtatttcaaaaagaagactggtcaaccatggtggtaattacaaagaaatcaagtgcaatgactttcttggtctacgatgatttttttggtctgcctagtgaaacagattcagtttcagaggactagaggtggagaagactaggccactacctcttagaaaacctcctaaaggccaccatagcctatggtcttgaaccagtggtcttcatagtcttttgctcacataccacttaaaataattttgataaataatgtgagctgggcacagcggctcaagcctgtaatccaaatgttttgggaggctgagtctggaggatcactggaccccaggagtttgagaccaacctgggcaacatagagaaactccatctctacaaaaattaaaaaattagccaggtgtggtggtgtgtgtctgtagtcctagctatttgggaggctgaggtgggagaattgcttgagcccaggagttcaaggctgcagtgagctataatcatgccactatacttctacctgggcaacagagcaagaccctatctctaagaaaataaataaataaaatttttaaaaaacattaggccaagtgcagtgactcatacctgtaatatcaacactttgggaggccaagatgggagaactgtttgagcttaggaattgaggaccagcctgggcaatatagtatgacctcatctctatgaaaaatttttaaaaattaggtgggtgtggtggcacacgcctgtagtctcagctacttgggaggctgaggcgggaggatcacttgaactcaggagattgaggctgcagtaagctacggttgcgccactgcactccagcctgggcaacagagcgagaccctgtctcaaaacaaacaaacaaaaatatagacatatttttaaaagataatagaaggctattttctgaatcttgtatttttaactgtccccagttctgaacttttttttaattgccccgtgcaatgtatcattcagggtgggtcagatatatgcctttctttcttttcttttttccatttttttttttttctctgagatggagtctcactcttgcccaggctagagagcaatggtgtgatctcggctcactgcaacctccacctccagggttcaagcgattctcctgcctcagcctccccagtagctgcgattactggcacgtgccactgtgcctgactaatttttgtatttttagtagagacagggtttcaccatgttggccaggctggtcttgaagtcctgacctcaggtgatccactcacctctgcctcccaaagtgctgggattacaggcgtgagccaccatgcctggcctttcttatgaagactagcagaactacaattatgaagaaaaagtcggcttggagcctcaaccccaggaactttctcaggtggagtacatctggaagttgaggatctggaaatgaatttccttaaatatatccatgcatgagtaccgcttaccaagccttcatttactttacggctattgcataccccatttgaaaaccagtgttgcaaaggactgggggcaatctgaaactactgggttcctggaacctggcactgattgatggggccagtgggccctaatgagattgcacctccattttaaaagcgtgaaaggtataaggagattcagagataggtgtaaatggcttgcgggagcctccaaaattttcaggtccaggtacctcccaccccttcaagggactgtctgatactattctatggctcctggaatgaagaaccagtcatcaggacctgctggcctctattaaattaagagtccagtcagatttaacaacctgaagatgaggtgtaactgtgaagcaatatatggctgattttttaacacacccatccaaatacatccactccagctgattcattctctcaactcccatgtgctaggtaatgtatgaggtgccagagttacccaaaaaacaaacaaagcacaatccataggccaagtcctgcagaaactctaggagagaaacttttaaagaaataattataaaaacactgtgatcggctgggcgtggtggctcacgcctgtaatatcagcactttggaaggctgaggcaggaggatcacccgagatcaggagtttgagaccagcctggccaacatggtgaaacaccatctctactaaaaatataaaaaaattagctgggtgtggtggctcacaactgtaatcccagctacttgggagactgagagcaggagaattgcttgaacctaggaggcagaggttgtagtgagccaagatcatgccactgcactccagcctgggttacaagagtgaaactctgtctcaagaaaaaaaaaaacaaacactgtgataaagagttaataaaactatgtgcaagagctaggggagtactgaagaaagagtgatttgagtaagaactttgtaagactttgagtaagaactttttaagactttgggaaaacttcccaaaggaggtcacattagagttatttattggcaggcgtgtagtacatcatagagaaaaagagatggcagtggaaggatgttccaggcagaggatgcagcatgtcacatgggcagccagtgtccaagtgacactcaaggggcaagacctgcttcatggacttgtgacctctgtagtcacacagggcccccctcttagaagggccctcacgcttgttttaatgttctgctgtcatcattttgaaattcttattttttttttaacaaggagacttgcattttcatttttgcactgggccctgcaaattacgtagcaggtcctgcaagagggcaagatgaaggcagggagacctgctgggaagttattactgcggtccaagtaagagataatgaaggggctaaatcaaggtcttgtcgtaacagtaatacacagccacaccattttcaacttcttcccagtgtattcctcagtttagatgtagcaatttccccaactggaaagtacttaggttgattttggtgttttgtaattacaaagaatgaggcaattgaataatttgctacaaataattttgtgtttgcacctatgcaaggatatctatctaggataaattctcagaattagaattgatgggtcaaaggtatgctcattttcaaggttgataggcattgccagttggtgacctgaagagagtaaaccaatttgtatctcttccaacagtatggaggagtatctgttttatcatgccctctttaacactctgtagtatccaaccttttggtatttgcagtctgataatgttaagaaagcagtggctgattgtcttaatttgcctttctttaattacaaacatggttggtcatttaaaaaattattataggagtctgttcaggccaggcacagtggctcacgcccataatcccagcactttgggaggccgaggcagatggatcacttgaggccaagagttccagatcagcctggccaacacggcaaaaccgcgtctctacaaaaaacacaaaaaaattagtcaggtatggtggcatgtgcctgtagtcccagctacttgggaggctgagacatgagaatcgcttgaaccaaggaagcagaggttgcagtgagttaagatcgtgccactgcactccatcctgggtaacggagcgagactgtctcaaaaaaaaaaaagagtccatttatatttctgtttgcatgaagcccatttagtccttcgccattattgaattgggtcataggtctttttcttattggtttataacagctgttttacgttaaaaaaataataataaatattttacctagtttatagtttgttgctttatttctgctttttttttggccatgcagatgaaggcctgaatttttgaaacctaagtgaactgttactgctttcactgtataccagtattttgcaatataagccctcttttcagggagtggcctttagagactattacacttatttttttagaagctcagcttgttcatttggagaacatacaatattaaagggaaaaaatgctcagcttgtacttattttttgaagagataatatatccacatgattaaaaagtcaaaagatacaaaaaggtatacagtgagaaaaatctccttccagccaggcatggtggctcccacctgtaatcccagcacttttgggaggccaaggcaggcggatcacatgaggccaggagttcgagaccagcctgcccaacatggtgaaacactgtctctactaaaaatataaaaaatagctgggctttgtggtgtttgcctgtagttctagctacttcggaggctgaggcaagagaattgctccaacccaggaggcagaggtttcggtgagccgagactgtgccactgcactccagcctgggtaacagagcgtgactccatctcaaaaaaataaaataaaataattaaaaaaaattaaaaaataaaaataaaaattgccttcccaccctgtcctcaaaccacttaagcttccctccaggaagtaagcactattatcagttccttgggtatctgtccctattttatgtgtaaatgagcaagtgcatgcacacacatgtattcttttttccgattattacacaaatagtagcctacaatatccaggattctgcacctttgccttttttttaccacttaacattacattttggaaataatgtcctaattattcataaattcgtaagtacttcctcattttaaaaaatggctgcattgggccgggcgcggtggctcacgcctgtaatcccagcactttgggagtccaaggcgggtggatcacaaggtcaggagatcgagaccatcctggctatcacggtgaaaccctgcctctactaaaaaaatacaaaaaaattagctaggcgtggtggtgggcgcctgtaatcccagctactcgggaggctgaggcaggagaattgcttgaacccaggaggtggaggttgcagtgagccgagatcgcgccactgcactccagcctgggcgacagagcgaaactccatctcaaaaaaaaaaaaaaaaaattacaaaaggctgcatagtgtcccattgtatgcattggtttgaatatgcttttaagggagaaacctgagtaagaaatactctcaagtcatttggggctggacattgagactgagtcgggggattggactgggaccttctctagatcctgaacaatcagaccttttccttcctccaggcctttacctcccattttctttttctttttttttttttttttgagatggagtctcactctgtagcccaggctgaagtgcagtggcaccatctcagctcactgcaacctctgtctcctgggttcaagagattctcctgcctcggcctcctgagtagctgggattacaggcacgcgccaccaagccaggctaatttttttgtgtttttagtagaaacggggtttcacccatgttggtcaggctggtctcaaactcctgacctcaagtgatccacccgcctcagcctcccaaaggtgctgggattacgggcgtgagccacagcgcccggccttttaccctccattttctgccaattaaaacttcacacagtcttccattgcttgtaacttttgaacacgtgtgtggtaatgttctgtgtatattgcatataaaactattagcttttaaaatattaccagtttatatagactcatctcaaatgctacttccttttggaaaccttccttgatctccctgatatccccagccagagtgacctcactcccctctgaaatcctatagaatggtgtaatgttttgtggttatttgtcacgccttttatgtgcacaagtcttatcttttttttttttttaacctgaagacggcctcacttgccccagtaccttccacagagtggcttctgagtaatgtttacagaatttttgaggtaattaatgaatgaacaaaggcaccaagggttaaggacatgaatttagtgtcagacacttgggttctactcctggttttgctgttttttaggtgtgtcgtggggtaggtcacttctctcaccctttccttagaatccacttcacaggacagtggtgaggattaagtgatttgatgtaggtaaattgcttttcattgactgttagctgctgaaataggaattcagaggaaggaggagagaggtcaaggagacttcctaagctggactgtgctctccagccaccctctcatttatatttcctttcagatctctactaagaatgtcactctggccgggcgcagtggctcactcctgtaatcccagcactttgggaggccgaggcaggaggatcacttgaggttgggagttcgagaccagcatgaccaacatggaaaaaccccgtctctactaaaaatacaaaattagccaggcgtggtggtgcatgtctgtaatcccagctactcgggaggctgaggcaggagaatcacttgaacccgggaggcaggggttgcggtgagccgagatcacaccattgcactccagcctgggctacaagagcgaaactctgtctcaaataaataaataaataaaacaaaataaaaaataaagaatgtcactcttccttgttcctgcattttctttttatgtctttatcttttgggtaaatttgcctggcttcagggcgaaggccctccagcaccaagagctgcctagtactgcagattcttacgaccactcaaatctttctttcctttataagaaacaagcaactctaccctatggttgagccaatgtgtcagtttcttcctatccaaatggatggcatcctgacatctgcagtgagaggccaatgcaatttggtgggggtaggggcaagggtgggggagttttgcagagcataaagagcacagtatcttggatcttcagcagcttgagttcagttcttaacttttcttgcctcattacaacagtgtcacaacccattttcctcatacattgagaactgctgcagtcaggcacggtgactgttacatggctgttatattggccatggatggccaacatagtgagacctccattttaaaaaaaaaattaaaattagtcaggcatgatgacacgtacccgtagtcatagctactcaggagactgaggtgggaggatcgctcgagcccaggagtttgaggttgcagtgagctatgatcatgccagtgcactccagcctgggtgacagagtgagatcctgtctctaaaaaaataaaaataattagaaagaatatgattggaaaaaaataaaaatacaagtaaaaataaaaaagaactcttgtgaggaaagcatctaacaatgctagacaaaaagtaagtaaccaacaaatgcaagttctccctttaagctcttctccacactggtaccagatttgtactgctaaaagtcctgttctttcctcttattatggaggaattatcctagctcatagccaacctcctcactcatatacatgcttactcaagggcatggcttcagcagttctcctctctctcctgcatcatcaatttttccctctctcctggatcagtctcaatcaacatacaaatgttatgtttcccatcttaaaaacaaacaaaaagtctgttttgactccactaccaactacagctgccacattttctccttcttctttgtagtaaaacttcttgaaaaagctataacctgtatactcaacattttcaattcctcttgaacctactccaatcagatttttgtcccatacactccaccaaaacatctcaagatcaccaacaacctccacattggtaaatctaattaccttctattcatcttcatattatttgatctgtgtgacacagttgattactctctctttcttaaaacattttattcacttggcttccgggagttctcactttcctggttttcttctttttggctcttccttctcagtgtctttggctgattcctcttcattttcccaacctctaagtattagagttgccccaggatccagtcattggaactctttgcttttctgtctacactcatttcctaagtaatttcttcagtcccttgggttttacatattatattgattctgaaaacctccaaattcccacttcactctcaaccttcttcctgaactcaggtccaaatatcaaaatagcctacttaccacatccacttgggtgagctcttcatatttctactcaaacctgtccctcctgcagtcttctttgtgtcaaataatggcaactccattcttctagttgctcaggtcaaaaagtttggtaattggtgaacacgccgtccacgtgcgccttgctgtctctccattatcgcttgagatctccagccttaccgcggcttgaaatggaccccaactgctcctgcaccactggtggctcctgcacgtgcgccggctcctgcaagtgcaaagagtgcaaatgcacctcctgcaagaagagctgctgctcctgctgccccatgggctgtgccaagtgtgcccagggctgtgtctgcaaaggggcgtgcagctgctgtgtctgatgtggggacagctcttctcccagatgttaatagaacaacctgcacaacctggttttttttccttaatacaaccctgagccatttgctgcatttcttttcatattaaatatgtgaatgacaataaaacaattttgacttgaaaaaaaagtttggtaattggtaatgtgactctccgctttgtctcatacctcctatccaatccattaacaaattctgccaactctactttcaaaatctatgattccaaaaaaatccaaaaaaagtgtaaagggaaaaaatacaaaatacaaaaaacaaaaaattaaaaatcaaagtctatgagaatccaactacatctctgtatctctacttggacccaggtctgagccgccatcatcttgtacttggattattgtaatagcctcctaactggcctttctgatatggtcttaaaaccttttctcagcccagcaaccaaagtaattctgttaaaacataagccagaagatgtctcttccactctcagaacctctcatcagtttttgttaagagacagggtctcactcttgctcaggctggagtgcaatgcaatgatgatcacatagtttacgacattctcaaagtcccatgctcaagcaatcctctcacctcagcctcccaagtagccaggactacaggtgtaccccaccattcctgggtaatttttttttgtttttggtagagatggtgtcttgaactcctggcctcaagtgatgagtgagagtatcaggagatgacagatgatgatcaggtgagaggatcaagagactgtcctacctcagtctcccaaagtgctgggattacaggcatgagccaccatgcccagccccatcagttttttatctcatgtagaccacccttccctccataaccttcatctcctgatactctcactctcttccactctaaccacagtgattcttacccttttcctcaaacctaccaggcacgttcttgcctcaaaacttttgcatttgctgttccgtctgcctggattcatttctttcagatatctacatggttcactcccttgttcctccagatctttacaaaaaactcacttttttactgaggccttccctggccactccatccaaaaattttttttttttctctctctctctctctctcacacacacacacacaccattcagatttcaagtcctaaatcctgcttttctcaacagaaaaaaaatgctatttaactacatatatatatttaaatcattttgttcgttgtctatcaccccagtttttttgtttgtttgtttttgttttgttttgttttgttttttcttttgagacagagtctcactctgtcacccaggctggaatgtagtggtgcgatctcagctcactgcaacctccacttcccgggttcaagtgattctcgtgcctcagcctcctgagtacctgggatgacagatgtgcaccaccatgcccagctaatttttgtgttttttagtagagatggggtttcaccatgttagccaggctggtcttgaactcccaacttcaggtgatctgcccaccttggcctcccaaagtgctgggattacaggtgtgagccaccatgcccggcctgctccattataatttaagttccatgaaagcaggaagtgttattagatttgttcaaagctctatcatcccagtaccgagaataatgttcaacacaaaataggtgtttcacataagtatttgttgaacttgtttcttgagtgaaatcaaacgttatcattttgctcctctgttttgggtcattctgcccagaacagagtactcatgccttttggtctcaggaccctctctacactcaaagtattgagggccagacacagtggttcattcctgtagtctctggtacttgaaaggctcaggtgggaggatcacctgagctcaggagtttgaggttgcagtgagctatgattgtgccactgcactgtagcctgggcgacagggtgagaccctgtctcaaaaaaaaaaaaaaacaaaaacattcaggctgggcttggtagctcatgcctgtaatctcagcactctgggaggccgaggcaggcagatcatgaggtcaggagttcaagaccagcctggccaacatagtgaaaccccatctctactaaaaatacaaaaaattagccaagtgtggtggctggcacctattacgtaatcccggctacttgggaggctgaggcaggagaatcgcttgaacctgggaggcagaggttgcagtgagccaagatttcgccactgcactccagcacgggaaatagtgcgagactctgtctcaaaaaaaaaaaaaaaaaaatttcaggactccaaataacttttgaaaattcaggactccaaataacttttgtttatgtggattctgtctattgataagtatcacactagggatcaaaactgagaaattgttaaatatttacatactaattcatttaaaataacaataataaacatgttaacataacatttttatttttaaaaaaataataaaaatttagctgttttgttccaaaacgaaacaaaaaaaatagtgagaggaatgctactgttttgcttttttgaaaatctgttttatgtctggtttaatagaagataattgtattatcctatttacttctcattcaatctgtataatgtgccatgaagccctggaaaactacccagtactctcatgagaaaatgagagtttaaaaagaaaacaatgtcttcgtattattatgtaaatggttgttgtctccatatatatctgttgtctttgtacatagttttccctcccattctacatagcaaactcctgctggtcactcaaggtctgtctcacctgccatctctagacagtcagttgttccctcctccctactcccatttctctattatagcacatattatgttatcttgttatctggataattgtctatcttcccaaccgactatcttcctaaagaaggcaactataacttgatcttctttacatccctagccccactcacagtatctagcaccaaaaagatatttaataaatattagt

SEQ ID NO: 593 - DNA, 20001 bp, Homo sapiens
agctaactgggtggatgaggtgggaggatcactcgcgtccaagagttcaaggttacaccgagctatgattgcaccactgcactccagcctgagcaacatagaagaaccttatctcaaaaaacaaacaaaaacaaaaatgaagaaactaaaaggaaaccagaaagaaagaaaatggagacatcacattggtcatagagaaatacaaaagtttagaaagaaatactatgaataattatatgtggacaatttagacaacctagatgaaatgggaaaattttagaaacacacaatctaccaaaactgacttaagaaggaagataaaattgtaatagacctgtaacaaataaagagattaaaatattaattatttttaaaaattccacaaagaaaagcccaggaccagatggttttactggtgaattcaaccaaaagcttgaagaactaacacaaagccttcacaaactcttccaaaaaatagaacaggaagaaatatttttcaactcatactatgaggccagaattactctgataccaaagacagaaaaagacattacaagaaaataaagttacaaagcaatatccttataaatatagatgtaaaaatcctcacaaaatattagcaaatcaaatccagccgcatattaaaaggatcatacaccttgaccaggtaggatttatcccaggagtacaaatgcagttcaacatacaaaaatcaatcaatgtagcataccatgttaataaaaagtcacatgatcatcctaatgcagagaaggcatttgacaaaatctaacatccttttacgataaaattactcagcagatgaagatgagaaaggaacttcctcaacttggcaaaaagcatctatgaaaaacctataactaacaccacacttcactcattgtgaaagatggagcatttcccccctaagatcaggaacaggacaagaatgttcattcacactacttctacttattagggcaattaggcaagaaaaaggaacaaggtggaatctagatcagaaagaaagaagtaaaaccatctctattcacagatgacattataggaattcttaaggaactcacttaaccattagagctaataaacaagttcaaggctgggcacagtggctcacacctgtaatcccagcactttgggaggctgaggcaggcagatcatgaggtcaggagtttgagaccggcctgtccaatatggtgaaaccccgtctctactaaaaatacaaaaattagctgggcgtggtggcgcatgcctgtagtcccagctactcgggaggtggagacaggagaatcactagagcccaggaggtggaggttgcagtgtgccaagattgtgccactgctctccagcctgggtgaccgactgagattccatctcaataaaataaaataagttcagcaaggttgcaggatacaagattaatacacaaaaatcagtagtatacatttgcaataaaggatcaaaaacaaaattaaaaccacacttccatttataatggcatcaaaaagaataaaatagttagaataaatttaaccaaagaaaagcaacacttcaacacagcaaactacaatgtgctgttgaaagaaattaaagaagtgccaccaagcaatctgacctgagaaaacatgcaggttcaacagaatgagtcctgctcttcagcaagcacccatcttgtgttcaagctgggtctatgaggcaagtttggcaacatagacaaggacatgcaaccaaatctgtaatgtagaaaaggccaagggaaggtggatcaatcattggaaacattcaacaatccatggaagaaatgttaaaaatagaatctcagggtctgatgaagttggaatatcactcttctatgtatttcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatcaaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggtaagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatgctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattgaaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgac

SEQ ID NO: 594 - DNA, 20001 bp, Homo sapiens
acaggccttctcagagtggctactttccagacaccagacacacaaatgctttaaagacaaaagcaggttgttacatttgtcagggtgaataaaaagcctagagcaggactctcaagtctctctttctgtgctaaggaatgtcttcccaattttttgcagccttgaggaccgggagatgactgggaaattgctgacagggcagggaaagggctatactctacatgctggcattcacagacaaacaccgaggggcagcaacagcaaagaggagtcttggtgctcttcctggagttcccaggctttactggccatggatcctgttattcaatcaaatacttattgtgtgcctactacatattgggcactattctaggccctgtggatgtattagtgaactaagcaggaaaaaaaatcacctactcatgtgaaggttatgttgcaatagactttggggacagagacagacaataaattaaacaaataagtaaagtttataataccttagaaaataaaaagcactataaataaaataaagccaggaagagatataggaattgccagaagggcaaatggtagacttgccatttaaaattggcgttcatggaagattacaggaaaagtcaaagtttgaaagatttgaaggagggaagggagtaaaccagatatttgggaagaagagtggtagtggaaaagagagagcaagagcaaagactgagaggaaggaccttgccagccatgttcaaagaacagtaagcaggattcatgtctgcagtagagacagtgatggggcagaggttagagatgaggtcagagaagcagttttggaccaaattatatatggattgataaaacaccagtttttgctctgatgtgggcagtcctcagaaagttttgagcagaggtatgacacaatataacttggctgctgaattgagaaggacagaagcaaggagattagttaggaggccattacaataatgcaactagtactctggcgatttcaataggcatcttaattttttcacagtctaccttcaaataatactatactacttcatacataatgtaataaccaagtcactgcaacagaatacttccattcctccctcattcctttgtgctattatcatattttactcttatgttataaaccgcacaatgcattattatttttgctaaaaagaaaattattttttcaaagaaatgtaaacatgaggaaagaaagtcttgcatattttcccacatatttactatgtcttgcactcttcattcttttttgaggtccaaagttccctctggcattttccttcatcttgaattttttttttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccctaccccacaacagtccccagagtgtgatgttcccctttctgtgtccatgtgttctcattgttcaattcccatctatgagtgagaatatgcggtgtttggttttttgtccttgcgatagtttactgagaatgatgatttccagtttcatccatgtctctacaaaggacatgaactcatcattttttatggctgcatagtattccatggtgtatatgtgccatattttcttaatccagtctatcattgttggacatgtgggttggttccaagtctttgctattgtgaatagtgccacaataaacatacgtgtgcatgtgtctttatagcagcatgatttatagtcctttgggtatatacccagtaatgggatggttgggtcaaatggtatttctagttctagatccctgaggaatcaccacactgacttccacaatggttgaactagtttacagtcccaccaacagtgtaaaagtgttcctatttctccacatcctctccagcacctgttgtttcttgactttttaatgattgccattctaaatggtgtgagacggtatctcattgtggttttgatttgcatttctctgatggctagtgatggtaagcattttttcatgtgtcttttggctgcataaatgtcttcttttgagaagtgaaattttctttatgatttcttctagtgcagaaaggctgagaatgagttatctcagcttttgtttgtctgaaagtgtcattttaccttcacttttgaaggatattttcactggggatatagaattctaagtcaccatatttttttctgcccatgatattaaagatgccattttattatcttctagactgcattgtttctagcaaaaaatcagtggtatgtcttactttgtttctctgtaagatgcctttttctttggctgcttttaagacttttaaagaatctctgattgtaattgtgatatacattagtatagtgtttttatgcttattctatttgggactcattgagcttcttggatctgtaggtttacagatttcatcaaatttggggatttttcagtcattaattttctatctcctgtcccatcttttcattctgggattccagttacatatgttagaaccctgtgttcccatgggtcactgaggccctgttcattatttttgagctttatttttcctctgagctttagttcagatagtttctactatgtctttaagttatatgattgatcttttttttctggagggtccaattaactgttatcctcatctagttagtttttttattcctgatactgtgtttctcagtttagaagttccatttgattttttctgtatttttcatttgtcacttcattgtgtccatattttaattgaaatctctatacatatttacatggctgttttaaaatctttgtctggtaattccattatttctattattcctgggtctgattctattgactaatttgtctcctggttatgggtcatattttcctgctactcagagtgtctagtactttttaattagttgaaaaacactatgaacattacgttgctgaatatctggatttttctgtcttcttctaaagactgttgaaggttattttggcaagcagtaaacatttcttgcaaatgagattttaaaggcttatgtttatgatctgttaagataagtcaaatgtagcctttaccttagagctaatttagtcctcctactgagacattacccttttgggtatctctaatgaatgcacgaggtgttcagtgcagtctcccaatgtggtgggaactgaaacatctcccagccctgtgtgagatctgggaaaggtttagctcacagttatccagtcacttccattgcccaacctcgtgaagcgtcaccatttgcatgaacatcttagcattcagcaaaaattcaagaagaatcctatgcatatttctggaactattttttatacataattctttcctcctagtgctctgtaccacaaatgtcagtaactttgttctccacaaattccaattttatcccttcaactcaaaagtcctgctgggctttgattatgtttcatttctctgtggcatagtccagaaagtaccttcaggctaaacttggagtgagcttagaaattatcttgtctgttgtccttctctcaggagccacagtcctacaataccggttgtccaacaaccaaaaatcattattttaaattttgttcaattttctgggtttctttatggtgggagagcaaggacagagctagaaagaacttgaaaaggaagtccacatccttcccttttgtagatgaagcaacagagactcagggtggagttgcagtacactcaaggtcacacagctactggtagaagcattaagctcagaagctgttttcgaagtccaatgtctttctcactccagcgtgctgcctcttacagaatgattggtagagtgtagcgtattagtttcctagggctgttgtaacaaattattacaaactaggaaacttaacacaatagaaatttattcttcctggccgggagcagtggatcatgcctgtaatcccagcatgttgggaggccaaggcaggcagatcacttgaagtcagaagttcgatgccagcctggccaacatggtaaaaccctgtctctactaaaaatataaaaataaaccaggtgtgatggcacttgcctatattcccagctatttgagaggctgaggcaggagaatcacttgaacccaggaggtggaagttgctgtgagccaagatctcaccactgcactccagcttgggtgacagagtgagacgaaggaaggaaggaaggaaggaaggaaggaaggaaggaaggaaggaaggaaggaaggaaggaaggaaggaaagaaggaaagaaagaaggaaagagggagggagggagaaagaaagattggcacttgcctatattcccagctatttgagaggctgaggcaggagaatcacttgaacccaggaggtggaagttgcagtgagccaagatcacaccactgcactccagcttgggtgacggagtgagagaaaatgagagtgtgagagagagagagagagagagaaagaaagaaattaatttattctttcccatttctacagaccagaaatccaaaaccaaagtgttggtagggctagttccttctgaaggttctgaaggagaatccattctataactctctcctagcttttggtgattgtttgaaattcttgatgttagttcacttgcagacaaatcactccaatttctgccttcttttcacatggccttatcctatcctctgtttgtttatgtcttctcctcctcttataaggatacttgtcattggatttagggttcacccagtaaactcacgatgattttatctagagatccttcactgaattatatccgcacataccttttctccaaataggggtacattcacaggtactggggattaggactggatatattctttttgggaaggggcacaattcaactctcaaaagatagaaaaggggaaaggtaaataatatagtcaaagtaacaatttgggaatatttatctcatataaaagcagacattgaagtttcccccagctgaatctattttggagaatttgaaagggtttccatctaggaccgtgaaggaaaaaaaaaatgcaaaagcaggttgataatgttatattttacctgggcacaatcatggtactggctcacacctcactacattcattaagtgcatcacgcatttaacaccattgttaatttggccaaataatccaagatgcaacaaggaattattgctttcagttactctaacctcttttgtctctaataaccatatcagtcatgactagaggcttgaatcctgaaaacggggacacgtagtaaagataaattactaacaagcccttacccataataggaggaaagtcatcactataataattctgtttgctgagatgacccaatgccagtttcagagtctttattaggtcaaaaggaaaggacatctaattgctatcttagctatcatttttcactaaccactgaaatgtgtggggttttttttagcatgaagtctttttttttttaatttttccaactttcttagcagtttcagatggtacattgtgagacaaaggcaaaagcaacagggagaatcatctcatgagaaaaattagcaataaagcactgtgacaggacagcaaaggcactttgttaaaaaattatttcaacctgaataatttgacagtgttaatttgttaagaaaaaaatatctagaacacataccaccctgagatccttaagcagttctctgaaactttgtttaatacaaacacttccactgcattgcaattgggaatacatctttcaacccacattttgcctggttataagtcctattgggtactgagcagaggcagtcaatttggtttgctttatgatctgaaccaaacacaaatattaagtgaggtcaaataacacaccccactggcaatcctcaaatctctaaagctgatttaaaagagactgggaaattgagctcaacagaaatggcaaaaataaagaagttcatttttaatgaacaaggaagcctaccaataccaatctccattgggccacagatgcctcattgtgcccaaattggattggaatgcacaagccaacaagcacaagcacaactgcccctccacccccacaaaaaaaatcacaatttggcagaagagaaagatttagaggaatgttaacttaatgcacctaaaattcaaatcatgattagaaaagggtattctggatatgacagtttaaggtaggtaaagagagttacgaatatgttcaaagtaattggaaaatgagcctaataccaagagaattacagaatattggtgatggaagagaattagagaataatttttaccttaaagtgtagatcctgagttcaggaagaagcagttacttgctcaaggtcagtgtctaaaactaaaacgggattagaacccacacccttttgagtctggtgctctctctactctgccaattgttctcaaggctgtggggggatgttaagagtttctcaaagttcacaactgggcctctttctttctctctcctcctcttccttatctcattcttttcccaagcttttattctcattgacagacttagtcatccaaacgtatttctccagttctgacatctctgaactccagacttagaatcaacagttctatttctgggtctcccaggccgctcaaacttaacatgtgcaaatgtaaacatctaccccccatccttcccactacagacttgttcctccctgcttgttctctatctactagatggaactatcatcttaccagtgtcagccttgaattggtatcttttctttactctttccctacagccaaccatcagtaagacctcctaagtgtatctcgaaaacatctatccactttctctgaccccaccttagtccaagccaccaacatcttgttcctggactgcctcctaacctctctctctgttctgatttttccacttccagttcatttgccacacagtagccagagtgatcttttaaagacattccgtttacaataaaatccaaacccctcaccattgcctataagatcaggcattatttgtccgcttacttctctaatctcatggcgtgccaccttcttccttgacccctctgctcctggtatactgaactctctaaattctcaaaacataccacgctttttctagtgcaggacctttgtacatgctgctcccactgtcaggagtgctcttttcattgtgaaaggctggttccttttataattccgggctcatgttatatgtcacttctaaaaaagaggcctttcctgatcactcatctcaatgacatattttttttaatttaatctttcaatttcaattaatctttaatatttcagaaagtatatcaacattgcctaacatgctgttttacacacaatagatacatgatcaatgtttgatataaatatacatatctttaaaatctttggtttaaccagctaaacttttaatattttatgaactagttagccctgagtcataaatttacctactttttttttttttttttttgagatagtttcactctctttgcccatgctggagagcagtgacgtgatctcagctcactgcaacctccaactcccaggttcaagagattctcctgcctcagcctctcaagtagctgggattacaggcacctgccaccacacccagctaatttttgtatttttagtagagacagggttttgccatgttggccaggctggtctcgaactcctgacctcaggtgatccacccgcctcaccctcccaaagtgttgggattacaggcacaagtcagcatgcccggccagatttacttattttttatgagatttaaaactgtttttagagatagagtcctgctatgttgtccaggctggagtgaagtagctattcacaggcatgatcattgcacactacagtgttgaacttctgggttcaagtgatcttccgacctcagcctcccaagtagctgggactacaggcatgtgccactgagtccggtgtatttttataagatttttaaaaagataacatattctaaattatgacgtccacataccatttacttttgtgtggaattataaggtgatattttaaatgatgggaatgaacaagttgacatgtatatcagtaacctctaaacatctatttcaaacatctattaactgaaagtgatgattcctccagctcttatactaagaacttccatacattagagcaatatacatattcaaaaagtgacctagttcaattagacaagtaaataattttcctatgtttaggtaaatttgaaaaatatacataattactacctcatcctagttagaatctcatttatatttattccactatgttcatgattttgtaaccaacttggaaggcatcgtattattaaaagtgtatcagattagctccctcaacttactatgtctagtaaccattctgaagaaataggcactggctttgaatatggcctgttccagtttgtgaacagtcgtaggcaagtaaagttgttgggcaaagaggtgagctataggatgactgagggtaaattgtcactactgtatataaagaagacaaatgagatataggaagagatctgttataataacatatatgacatatatctaagtttttcatatatttcagaattatagaaaaaaaagtatgtaatcttttctaagatgtatggatgacttacttttaataatatttcttgatttataatgtaaataagattaagcgaatatgggttactcttgaatttaaaaattggcacatgtaaatgagcattttaatacaaataattagaatatatttatactgtatacacagctacacaacggaagatactactaaaattttgctctatagcacattaccctagaaaacatagaattctagaattctctttaaaaagatcactgagaattattagatgatgactgtgaaataggttctcccagtacaatactacttctgtcattcaaagttctgacaacagttgtagctgaagactgaagcactttatgagaaagcctcattcttccatcagctgggtcacatccaaagtatttcacctgaatttcttggccaacttctaatcctagggcagtaggatgtttaatatttcattgatcaagttgtgtgttataaagcagtaccaaaatcatatttggatataattttaccattacaccagtatctctgctttcagttattgtggcagtacacactgctccaaattctaattgctgctcctgatcatccttgcggatttcagcaatgaagtctcttgcctcatgcatagcaccgggtgttggtgcaaatatagaaaacgtttcttcatccacctgactaatagttacaactgtttcagcctgaagttttttaagttatatccacctggtccaacaaatttttctcattttgataatggaacctgaacagtttctacaacaggtccattttcttttctagatgcttgaggttttgaaatagctttgttcatgatctgtaaaatctcctttttgccactgaagcttgttgaatagcctccattacaattttcattgttattccaggtaatttaatatctgcctgtaatgcagttattcctttattagtgccagctattttgaagtccatgtcaccattgtaagcttcaattcccagaatatctgttagcaaatgataatcttctatttcacccttctcaagatcggttttggtggccaatcccattgctacacctgtgacagcagattaaattggaagccctgaatccattaatgctaaacttccaccacatgcagatgccatagaagatgacccatttgactctaggacttcagatgtaactcttatggcaaaaggaaaatctttgggaataacaggatacaaagctttctcagcaagagcatcaggcccaagttctcttctatttataccggtgactttgacaatttcattagttgcataaggaggaaactcatagtgcagcatgaaatttttatcttttatcccatttatagttgttataactcgatccaacttaatactggattctaatgaatcaaatgtaacagcacaaagcagctgtgtttgtcctctttgaaataattctgatccatgaagggttttaaacatatctacctcacaacttatattccgaagtaaagtcaaatcccgaccatcgcatcttttgtattcattcaaaataatacttctaaaaactttctttgcaacagtattgaaggattctattatctcatatagatcgacctctggaaatatttcttttagttgttcctctgtatctaatcttattttgttaacagcttcatctctggaaattttatcatgttcataatctgtaaaaactgcatagagtctctccatagtgagtttatgagcatgtttcacaatctcttgtgaaggggtaaataacttctgaggtgtcctcttggtaacaccaatttcttttaccagctgctggatgccctgaattatttgctgggtatatttcactcccactttgatagcgtggcaaaagtcctgctgtaaaatgttctctgcagaggcttccaacatgacagtctgacttttaggtgctccagcaaccactacatttaaagtactagaagacatttcttttcttgttgggttaacaacacattctccatcagtcattcctattcatactgtcccaacaggtccattccaaagaatatctgataatgagagggctacagaggttgccattaattgctaggacatcaagttcattaataccatctactgctaacagattacacagaacctgtatatcacagaagtagccagctggaaagataggtctaactgaacaatctactattcaacgtgtaagaatttctttatcagaagtactaatctctcttctcagagggtttgtgggaattctacctactgcagcagccttttgtccgtagtcaaccaccaaaggcataaactgggaaggggaaggttttgttttactgacggctgtggccattaccgcagtgtcacctgactgtattacagcagagccatttgcaaatctggccagctttccagaggatatttctaatttcctgttgcccaagtccatggccacagcttgagaccctgtgctactcaatagtgctcgcacctgcaactggatgagtgcccgatcccaccctggcagacagaagggaccatcactcagcggccggagccacaggctcagtgaggtcttagcttcctcctgttatcctctgtagcaatgccttagtgtttccttcacagcacttattacaatttgtagtcatttactgatgtgattattggttattatccctcatgagtctcacagctaaatgacagcagggatcaagtctgtcttcttccctgtgtcacagctgtatctggcaccaagcacatacaaggcatttgataagtattctttaacataatgaaaatgaagtacatttataacactattctttctacccaaagagaacaaaaaaattatggacttccattctgtgtcaatatattcaacaggatagaagaaataacacaactgaaggttgcaaaatactgaaagttatcaacgcttattctctagagatccttgttaaacaatgtcccatccatcaagggtgaattagatttgtccctggcttgaggacagaataagatgacttcacccgactccttataaacttataattttatgaaaaatccatgagctctcatctttccagcactctgataacgaggtaattacccttttaatgaaaaaggaagcctttttatatctatccccattgaattatggacctcaaaattgaaatgaagtctaatagacatcaagcacaactacctgccagttcctaacaaggatgaggaaaaaaaaatagtgatatctggggagccaacgggcagtatgacagggtgtccttcctgccttctctgatgacactttgctatcaacaccagttcttccttttgtgccttactcagtttgtaagccagtctgcaacagtagaaaagtcattagtcacccttccctatctgttccatgggctttgaaatgaagccctggttcaggttcccatttaggtgtgactttctccattcctactatgttgactgtaatcaaagggctgggctcagtcctgacaacacgttcagatcccacactgcactagccctgctctagaatctcaatctattttcccagtgtcctaagacctgtcaaagcccctgccaccagcctcttccactactgactgagctcttccatcaaacgactgattaatggaaccacaacaccgacaccccacatgaattgcacccggagcccacaatccatactccttccccatgctccttcagtttatcgatgctgtttaattatcagtagtggctcggattaagccctaaacatctagctaccctgttccacagccaagactgttactctcactcctcactcctaggtcttgcctaactccccccatttcaggtattttatagctgagtctctacaagttatcactcacagctaaattcacacttttacttggtctctacattttaatccttggtgatctctttttatgcaattgccagtttagaggcataatcttgtaaacctttaccttctggacagtagcatcggaaagttcattactttcagttacgatacaacagcgagtgacaaatgcagctttggaaagcggaaaacttctttctccttgagagtctctgcacaactttccacatttggaacccaaggacatttcctttctctctctgctaacatggagtacagaaaggttacattagctaataaaagccctctgctgacaaaagatgcgtttgaaaagtcactcgaaaagggagctctctcgatagctttattaaaataaaatgccatatctttgtgaagttaaaagtctctggattgtggttaaaagtctggtctgctccttatacaatggaaagtctttcaaaagccacgtgtttcttaagctggcctcaccatgcataacagctagaatataaatctagactctcgccgcccatctatcttttcttttctgtgtcatgtagaggttcctatgtgaaggaaagatctccagaataagatgagagatagcttttataagaacaccaaatgatagaaattatggaaatcatgatattgaaataatttcttccaagttaaaacatcaggaacatttttgcttatcagataggcaagaatacttaaatttgaatgttggtcagcattcaacaagaaggcagtgcctagacccttggcttatgaattgggggcaattgcagcttccttcattcctctgaagggttgagaacttatgcaaagccatgggtgcagtgctgtccgacgccctgcagaggtgatgccaagagtaaggctaaatatgccgtttttgagagggagcccagaaagccagacttcagcagacaccaaagagtctattgaactactctgatgggaggatatgcaagagcaatgctgaatagtaacacccctgaagagagacaccatggaaagtagttgtcggacttgtggctacaaacaacaagaaagtccttcgcctggagctgcctctggaaagagcagctagactctagctggagagtctgacagagaaacacttcctagcagaggctcagcttcttgcccttccagaatgagaggctgtgtggttttgtgttcaagatcacgctatgaacatgatatgaacggttggtatgtcgagacaccttcattgaaaagagagaataagaaattgctccctgaaacctagaatagatggtgccccaggattgatcacaataatcattgggaatatacattgtagagacctcagattcctattgcacatgtgtcctacaaagaagggttacagagattctatcttgaattgtttgtgaatttttccacatgcattacttttgctggattataaacttctacaacacaaccatatgtttcacttcttataaaatctctcacagggtctaagtcaaagtcaaaggaccgtcattaatcagttgattggcactagagtggttggcctagcgttggtggacatagtcattctcagtgtcagaaaatcttgcaccctatcggaaaagcgtaagaggaaacacaaaaattaaacagaggatacagcaacataatagttctataaagatagtacatactgggagtctaaaaaacatccatatcttttgacataaatctattgctagaaaatcatcctaccaaaatatctaaagagtaaagaaactttatgaagaaagtcattctttgaacagaatatagaagcagaaaaattttgaaacaatctaaatatcaacaatagaggatatgttatataaactaagaatcttcttctgtgtaaacctgctattaaaaataatgcttaagaagtattttcaaaggtttaacaagtggttatgacgtaatgttcggcaacaaacaattgtatacaaactaggatctcaattatgttgaagtgtgtagaatattgacagtgggtatttctgagtggtaggatttggggtgtttctaattttcttgtttgaactttctattttatacttttcaagtttcctgcaatagtaatgttttacttttataatcaaaaaactattgaaataatactttaaattatgcatgtgaaaagattacctggtccaggtggtcattgtatccagctgaaggtgttaaatctagctagactctggcctgggtcttgagaggttagtatctataccccaccttcccttctaaacaggttagcaagctggcaagctggtaaaggagcctagcctcttcctccctacaggacactgcaacatcaaaacaaagcctctaaatactcccctaaagacaaggaagactaatatctgtgacgtagctattctcttctgggacatagaggaaaaaaataggtctctctcataacaagacaccattcatttctcaggttaagctgccattaccttcgaacacacagaagctgagggctgtttctgcagccctatcctacccagtcagccctctgcgtgctctcaactgctattctcactgcagaccaccattttcagacaaagctctgaaaagccccttaatgcccaagagccacaggttgtgtttgtgttaattactacagggctcagttcacaatatcacttaataaaaattaataattttcaagaatagattcataatcttctcagttatcagaacagctgaagttatttatgtgcttattggaacaatattataaatgtttgctttgttttaatacttcattgatgaatcacataatagtttataaaatcatgtttttacctgatatacttagttggccatgttttcctgattacaacaaacagatgaaaaataatttctgagttatttcctttttccttcagtatctcaaaggatgttcactgtgaatactgacaaaataatttattattattttcctagattctgaccatctgctgctaatcaattcattagaaattcaactcaaaaagaaaatttttggagatagtatgttaatataccagtttagagaaaacaacatacaattacttttgcacaaagtcagttggagaatagtttgagaactgtctagagacagcaagatattctcaagatgctccaagtatccattctgactctatgactattctgagcacaaactcaggattttagtttccttcactaatatctagtaataaaaaacctccatgtgttatttatgagaacagttaagcagataaataataaagtctcctgacacttcaaaggaaaatgaagaaaatatgagtaaatataaaatcaattcatcagatacattttaaattccagctgttagagtcagaaggaatcacagaagatcatttcactccatctcctgggtttatgctgataagctactgctctatccatatgagcgaagatgcagccgcaggttaaggggcaagcctgttgccatacagctggttagcaccaagaagcaaagtgaagttagatttcagtttctagtatcctcatacaggcctcttcccaatgagccaagctacttctcttttaaaaataattctgtctggaacattaagggggtcatccgtactgattcttcatgttttaaatacatattgtttgccagtcattatgctaataagaatacaaaaagaaaacaatatatagtatcagcacttgaagacctcacagtccagtaaggaaaacgtcaacatgaacaatacccatatgatacttgcatagcaatgtgagcacagtgctatgggaacatagaagagggagcaataaattctgctaagaaagtgttaaaaagtttcacagaagagctaggccccaaaggatgagtaagaggtatttaggcagaaggaaccatgaaaacaaaggcagggatgtgaacaacatctttgaggaggagccagcatacagaatgaaagatattgcgcatcaaaagcaaaacagcctttgcttttacacagacctatcatggtaaagcatcctcacagctgtacacatttaggtaatctctgtgttccccagcccctctaaagagcatcactgtgtcctccttgcctatatccatgccctctgtcaggaaaggccttgcccttttcctctatgccaactccccactgtccctcctgatacatctccaatattacctcttctccaacctccctgggagagttaattacctcctcctttgggctcctataacaacttttacatctcttgcaagaggttacttgaattacttgtttacatacatgtctatctcccaaacaagtctaaaaatggtaggcttctaaataattatatgtttgataaatatgaatgaatgaccttttctatggaaagctaggcgctaaaggtgatagagagataacatgcacatacgaactctcaagggaaatagacagacacatagataatgtataagtagaataataattctttgaattgaaatccccagggaaacattttcactcaaccgaaaatctaactgcaatctaaagattttcacatacaaccacttggcattgacttacaactccacctagataggttcataaagtcagatccttttcttgttacattcttagagctcataaaaggtggtctgaaaaggcaactctttgggtataatttagtcttattaaacagaattgtaagggagagaaaatgactgtctagtcctttatcattgggcatgtaatccattataaaggtgttaagctcactggtaagtgtaaaaatgagaggaaatgagtctactgacaaaaaatgcaatgagacaataaactaaaattaatgcttcacaaattctcagcttctcagccttattgtctcaatttgttattctcataaattatcagaaagtaaagcacagccactgctcctaaaaataaaaatcttattaaacttactatgtataaaactgcctgaagacattggctctcctttgacctcatgagttactcaagatactcaatcccagggttcaaaaaatatatctcattagcagtaccagatgtcagcagatgtgttattaaactgcctgtcactcaagcctcaatcctgaaaaatacctaggtcacctaatcctttatgccatccacatcttttcacatataataacaggaactttagtgcctggaattgttattaataataattccaaaaactcaatcatttctgggatgcctttgagttaatgggaaagaagctactatctgcctgacaaattgctgcacactggtaaaagatgattgacagaggatagatagtgtattagcctccttgggctatgtcataatccattcagctggctatcacaaaataccataaaccaggtagcttataaacaacagaaacatttctcacagctctggattctgggaagtccagcatcaaggccctggcatatctcttgtttggtgaaggcccactttctggttcacagatggcaacttcttgctgtgtcctcacatggcaaaaggggcaagagagttctctggggcctcttttacaagggcagtaatcctatttctgagggacctgcccttcataacctaactactttccccaccttccaataccaccacattgaggattaggattcgatgtatgaatctggggtttacacaaacattcagaccatagcaggctaccttaaaaaccacaaaccggtggcttaaacaatagaaatttattttttcatacttttgctagctgaaagtccaagacgaaggtgtcatcagggttagtatgtagcaaggcctctcttcctggcttgcaggtcactgccttcttgttgaatgctcacatgactttttctctgtgcactcacagagaaagaatgaaatgagctctctggtgtctcttcctgtttgtataaggtatcagattatggccccacccttctaagctcatttaaccttaattatctccttaaaggtcctaactccaaatactatcaccttggggttaaggcttcaaaatatgaatttgatgagagacacagttcagtccataacagacagactgatggatggatgtgaatggatggacagatggatggatgcatggatggatggatggatacatggatggatgcatggatggatgcatggatggatgcatggatgggagggacggagggagggagggagagagggaagaagagaaggaaggaaggagggaaggaagagagagaaggacggagggaaggagggagagaaggagggagggagggatatgattaactcatgaaggaggtaggattacgatcagacttaaatctgctggaagcaaaccattgcctgtaaggtaaaaaattgagaagtgttagaaaagcctcacactgctccaacatgctgcacataaacacgagccacagtgcctaaaatttcatattaaccaaagattcaacaaacatttatcaaggaagaactttgtgtctggcactgatctagtgttacagagcatgttaactgaattcctcactgaagacatttatattctaacatggatgaaaaaaaatctatgtataagaaagttgttcttaacctgaattacacaaaggatcacttgtgggactttaaaaaaatacatattccacaatcatatcttctgaatctaaatagcctgaggtaggccctgggcattgagatatatatatataatctctccaggggattctgaagcacagcaatacgaaaatccagtccagactactgagataagcattggccttttcttctaaacactaatgactctagaagataatatgtgaagaacctactaccgcagtgtaaataaactcactagatggctagcaataaatgatccagaacaatatgagactgctgggcaagagaaggcatgattgatttaagataatgtacacgaaacttggtagcagacatgaaatccctttgtaaacataaaagattattactcctcagtaggtcaccattttacaaggcagatcatttcattttaagagcttccaaatactgagccaacacatggtttttttggtaactttcttccaatgtgtctaggtccatagttttcagcgcatgccttctcccgaagtcttcagggtgagactccacaatgccttaggtctaggaccatagccctctgaagttcctgagcaagtctggaccaaggctgatcaagatcactaggcttagcaccagaagtatttgagagtctggaattaatcttgcggccattaccgcgggcttcagtgggttataagcccagggcaactgcatatctgttacactgcagtgttccctttaattccacct

SEQ ID NO: 595 - DNA, 61025 bp, Homo sapiens
tttaaactagcagtgattatcctctaacaaattatataatttacttattcattatgcctatggctttttgtctcccccattagaatgtaaattgcatgaggggagggaccttcatctgttctgttcactgatatatttcaaatccttttaacagtgcctggtatatactaagttttcaataaatattattgaagtgaataaatgaatcaagggaagacagccaatcttgtatattgcaaaacaacctaatgtcactttcttcccccaccccaccgcccccctgagacgaagtcttgctctgtcacccaggctggagtacagcggtgtgatctcagctcactgcaatgtccacctcccgggttcaagcaattatccttcctcagcctcccgagtagctgggattataggcacctgccaccaccctggctaatttttgtattttctaatagagatggggtttcaccatgttggccaggctggtctcaaactcctgacctcataatccaactgcctcggcctcccaaagtgctggggttataggtgtgagccaccgcgcccagcctctaatgttgctttctcatgtcctgtataaaatccttccccaaaggtcctcctgaaatctgcttcttgattggttctcccatatatatagacatatctgttgtaacgttttgacaagtatttagctttttttttaatactcatctcagatgttggttgaatgaattaaatgagataacctatgtaaataggacttaggtccagtaagataggatgcaaattagaaaaacagtgatgatttctgtgtgatccctcctgtgctgtgttcttggtgactaatgagtgtcacagtgccgaacacacaatgaattctgacttaattgaattgtcgagaggtgtgctggaatgctgattgatttatattaggtacaatgtgaattataatttaggctgtcactgtggattgctctcagtcaacaaagactatgtaattgcaaaaggcaaggacaggatgaactctaacttaagataacacttgacatttgcaaagaggaaatgggactttacacagccaatagcaaatgtgtggctctcattactcccaaaggaggtacacgctaaaaatataaatgggaggaacatgaccatacctacattccaggctgagaggccatgtgaggttacagcccttcctcttgagcgtaacttaggggaggacacccggcttacccaccacctgttcctccgtgtcagtgtcagaaagaggcctggtccagctggctcaggtcctgactgagccctcctggaggttctcatgtgcctgagagagttcctgaagaaggtttctggactagttagggagggtgtgtggacggaggtcagggtaggaacatgatggaagtggatctgtggctggtgaccctggcagtgggatcaggactgcctctcaggctccatcatcacagagccaagtgtcagggtgggggcagaagcaggccctgccaggtagcactgcccggtgtgtgtctgttccggggttggctcatatgttggcttgagggactccctgataaaagtagtaggagacacatggaatccagtgtttccaggtccagcaaactatccaggcaggggagtccttaaaagggtgagtgagtgtgtgtgcgcgtgtgtgcatgcgtgtgcatgtgtgtgtgtgtatgtgtgtgtgtaaactctactcttctggtgaccttcccattttaataaagaacagaaatggtagatccaggcaacttggctttgtcactttctagctgaagaccctgggcaaattacttgatgtttttgggccttagtttcctcagttgttaaatggagtaataatcatattcaacccatagagttgttatgagaatcaatgaggcaatatgatacgtagtgcctgccacatgctagccattcaataagtgagagctacaaagaaagtgaccaaagcctgagggattggcagagataagaagagtaggggccaggcagccaggaacctgcattggagcatgtatgtgaatgccccatggagtcctctgggacaccagctgcccagtggcaaaccagttcagcaattcttttttttttttttttgagacggagtctcactctgtcgcccaggctggagtgcagtggcgcaatctcggctcactgcaagctccgcctcccgggttcacgccattctcctgcctcagcctcccaagtagttgggactacaggtgcccgccaccatgcccggctaattttttgtatttttagtagagacgggatttcatcgtgttagccaggatggtctcgatctcctgacctcaggatccacccacctcagcctcccaaagtgctgggattacaggcgtgagccaccgcgcccggcaagcaattctttactgaacagctgctgtgctccaggtactttcctttagagtctgggaacagagagggaaaagcctagatttgtacttcagagttcactgtgcagaagacagaaaggagaccagattattagaacagacagcaagatgtgcaccagttagcataagtaaaaggactagaacaggcacacaggagtgctaggctgtggggtggaagctggtgaggctgtggggtggaagcaggcttcacagtggaagtgaggttccgtggtctcatctagaaggggaaatgcatttcagaggggagagtaggggccaaggcatagagctgcaaaacaatgtggtgtgtttagggaagtactagtggttcagcatggctagtatgagcaaaaaatatgaaggagggagagctggaaatgcgactagagagcactaaaaggtttaagttaccctataacaagtgtgggtttttatgttgtggcactagggtcttccagaagagtttaagcatacaagtaacatggtctacccaggggccagcatcttcctaccctacctcacctatggctaggagcccaggaactcttttcagaggaagagtgcccccgcctgtagcttcacactggcaggggtgcgaaggacagatgtaagaggggaaacatggaggcacggatattgctgggctacagtgggatggggtgaggcggtgctgccaccaggctccctgttacctggaacaccccctcctcagaaggctgtagtgattcccactcaggagagtccatgaactggtatggaaagatgtagtgcagaaactgcccatcctggctcacacgaaccctggcaagggaagagaagagatcatgtgggaaaaggaaaatggctctccaagccacctatgctgaagttaggtgtcgctgattaacatgaatcttcctgtagaaatactttgcctaaagcatggtaaaacccaaagctagactagccagcctaattactgcatgcaagtagttcagaaaaggaacccattgagacttccagaaccctcatttttcctcctccttctccttactggtggttctcaatttcaggctgcagagtagaagtcccagggaagcttttaaaaaaaagcacctaggcttgggccttatcccagagcaattaaacaagaatctctctaggtaggaactggatattattagtatttacatctccccagtgattctaatgtgtagccaagatagaaactactgcttaagaactctgctgctggcccggcgcagtggctcacacctgtaatcccagcactttgggaggctgaggcaggtggatcacctaaggtcaggagttcgagaccagcctggccaagagagtgaaacccccatctctactaaaaatacaaaaattagccaggtatggtggcgggtgcctgtaatcccagctacttgggaggctgaggcaagagaatcacttgaactcgggggtggaggttgcagtgagccgagatcacaccactgcactccagcctgggcaaaagagcaagattctgtctcaaaaaaagagaaaagaatgctgctgcctatttaagtttacatttacattaattaaaattaaataaaattaaaaattcagttccttacctaattacaatatgggtgttcaatagccacatatggcctgtgactaccatgttgtacaacatagatctagaacgtttctgtcatcacagaaagttctgttggatccgctgctccacagattctcctttctcccttcccattagctacatgaagattcatgcttacatttaaccactttgtagactttgaaggaagtggcaagtctaccatatgccagactctgctagacactttaccagtgttctcttatataatgttcacaacaccacaaggtagattattcttttctgtattttatagctaaggaaactggtgctcagaagggttgagtggcgagcttaaggctacatagcgatcaagtggcggaactaaaattctatgttcttagcacaacaccatgttgccaccctattactacagctttgggtagatggtagtggactctcctagcatgaccctttcccggacctctctaaccgtaggtgacaataacagcttgtttctttagacaatgagatcccatgcaccctatccagctgatggtcctagagtgaacacctgactcaagctgagccaatcaaactccttccctgggaatttggaaatggaattgcgtgtaaatcatgccttggatggggacaattatcaggcattattaacaaaactaacacactcctccctgaaggaactaaaaaaaatttttttttatcacgtaactcagactttgaaaagcatgggtcccaattggctatagagaaaataaacttgaaatcacataaaatgtcctagtaggacatgttcttgtttctagcactacctgaggcttaggtgcatgtctttccttgagtttcataagaaatccttgtatttttttaaataaagaccttttttcccccttctgttggctagagtgggttactgtggctgcagccagaaatccgaattatttgctttaattttatgaatattcttaagtcttaagtcttaagtcattaactgctcttgacttgcccatgaccacaggcttggtttcacaacttaaggggttaggagccttactattgctgcttggtgcctttgtacccttgtggctgtacctagcctagtgctctgcccctgcagggtaaaaagactgcattccatgagaacttgttagaactgatggcatgtcattgatgatgcctgaggacagggagtgtatttcagatgtgaggccacatctggaagaagattagaatccagtatgggctttatccttcccccaacccgacccctgcccagaaaactcagagtttcatctttaacctctcttctaaagtgagttatatcaggcaataggggtgcctctattaggcaaagggggaagatgaaaaagatctctaaggtacaccttgttcatttgggggagatatccttccattatttctggaggtttattggctaaacaaatatttctggagcatctctcatgtttctggagatctgggaatgcagagatgggcacaatctggtctttgtctttgaggatttcacaatttagtggaagtcacaggcacataaataactggctgcaagtcaatgtgataggtgctattgtggaacagtaacagaggagagagaaagattggttctctttgggcagcagacctctcgaaggagatgacatttgagctgaattttgagggatgcaaagggtattgagaagcagataaagatgagaatgaacaaagacctgggaaatccagtgtggcagtctgttctccagtatctgctttcttctcttccttaatggtgctagattttaactggacacatgactgcagagaaaaaaatcaacatttctctacttccctggctgctaggcataggcaagtgataagtcctggccaatgggatatcagcactcctgagccttgctcttaatgaatgcctaggtatacatgcgtgtatacaaattaccaaagaccagcaccaattaaaaaaacaattgcacctattatctgacaacctaaagctggaagacaggagctttattcaagactctgaataaatatgtatggaagggggaaaagaaggaaagaaggaagcaagaaagtaaggatgaataaatgaacaaaggaaaccaaggaacaaactcacttgtgtcaccataaaaggggatcaaaacctcactgaaaagcttccatagcaaaggaagacagcagaagagaatggcgctgctgcagcatatgtcagctccttaggcgaggatttcggccacccaggcaagccaccaaagagtgacaaccgtagagtgtagataatgtctaatgatcttcgtggctcgctgaagccatttaaatcggaatgctgtgccctttatcatctgtttcttcttccttcttgatctactggaagatggatgatcttctcctaaatgaatagcttagatagttagttgcctgctcagggggttgtatatatggaagtttgtgttttgaattttatatgagagaaacgtctaagttaagcgctgcttaacagggtgatagactttgagaaagtcactttccctctctgagttttgaaagagattggtttcctttattaaaacaaaacaaaaagacttctgaggtttgagtgaaggactctagagaacagtgtgcatgtgagatgtggaagtctgcacaagagtccccacttcctggcacaaagttcttgtctgctgctttgagatgtttggtcccttactgtaaccagcccaaggttcagtgattctcctttaaaactagagcccagtcatagactagaagccttttcctctatgtccagctcagcaaagctgagacagggtgacactgaaagataacaaaactcttactccaaaccttgaaaggcaggaaaaaaaaaaatcaaaattgtctaatttctgactcagccttttgatgctaagtataccaggaaaagctacaccaagggcaagcccccctctccccttcactgggaagtgatcttatacaagttcacagtaaatctatcctaactgaactatacagtaaccatacatgcttccagcaaatgggcaccctacactggagggagcacttctgctgctctcaatttcctcctttgaacagacgagctataacatcatgggtctcatgaatgagcaagttccctaaattgtctttaagcatggaactataggtgcaaacattttcacaatagttatatgtatttgtatttacatctatatctgtttacaaataatcgcattggtttacactttcagttcaccaataaatgaaatgaaatgtaccctcacaaaatgtctcccctcctagctcactctatccaggacctctgagttcaaacaaaatcaaaacatatatacatgatacttcaggttctataaatgaatacacaaacacgtattattactattagtggtagttgtagtaccattagcatcattgtcaaacttttttctccattgtgtggttggcagtattatctggatttgctttttttttttttttttcttggaattggagccttctaattgccatcttaccttttctatcacattctcctggtctcaagaaagctggtggagtgggggttgtggggctcaagagccactagggcagtataaaaaaatccacaattgcctactaagtgtgtagcacagagccccgtgatgttttctcagaagaaatcaatgcccaacattcacatccaggttgactgggcatacactgatcctgactaagaccatttctgcccatatctgactgtcagccttctccaaaagaggcggtgcttccacaaaagccttgatgagataggtgtatcacttctcttctcccattgttgggccctcagatttacagtactgtacttgacttcttagtcttcaagaacctcaatagaacaactggaaatggaaaggtgggcaaggggtattcactctccctacctggctacatacagctaccccaaacacaagtggggctgtttgcttgatgccttggcagggaacaggggttatgagaaccaccccgctatcccgacctcccatttctggcattgttccctgaatacagttggtgcttagcaaatgttgaatttgagtaaggaacagattaaccttattgaaatgttagtttttcaaagcttacagagatattgctgcagcttaggcatgacacactgatatgtgtgtggtgatggtagaggggttatttaaggcccaggctcaagacacacgcactgcacaccttccagcagcaagtgcacatacaatcattcttgccaaccaagatgcctcatgaactggtttcttcttggaaaatgccaagaaagaggaagcaaccccactcttagaaaaatctattttggtttgtttgacttgtcacatccttccctcaatggaaggggacacgaaatggaaagggacatgaaatggaaagggacacactaggaaatgagaagtgtgggctggggaaagaaattctgggcaatggatagagtagcttaccggccagagagcagcagggacaggcggttgatgggtgtctcaccctccacagcataggtctgttcagtggccagagttaagacctgctcctcgcagcagtgaacaatctccttgtatgtctgtaggggcacctgcaagggcaggcacagcgtcttgtagaggaggtcaaactcctcagggagggtgtcctcacgcaggcggtataccaggtgtgccagctggagcaggcagaccacagccagcaggaagctccaaagaacaatgtccaggccacaggcactgaaccagccccacagcacgcagcacaggtaacctgcactcaggaagccaaaaagatagaagcatccatacaccccactgccccccatgaagcccaggagtaagaggcagttggctaggtggtagacagccccttccacatcctgcttccacctaatgcacgctgaaccctgcaagagaagctggcccactctgctgctgttggcgctcatctttggggcctctcaaagcctcactgggctctaatactgtcctcacataggaaattcagaaaatgaatgaatccatccgctcaggggtcttctcacctccggcttctcactaccgactccacctttcctagaaggaatgcttccggtggctttgggaaggaatgatggaacatagtacacttcatggagaatttaaaaacctctttctctctctctctctctctccccctctccccccctctctcctccccaccacccccgctgtctcagcaaggctctggctctccctgcagagctctggcaagcttccttggttccatgtttcttgggagtcttcaaatttggttcttagcagaaaaacctaaatagtcccaagggaaagtagcactacaggactgaaaagtccagcagcgtgggatgatgcggccacatcctgctctctgtttttcccaagcagaatgaggagagccagcatgggaggcacatttgtgttccatttggaatgtgttctctcttggcaccggaagaaagggtgaccccagatggataccatgtttggaattggaatccaagaggtactggcagtgagaaaaaacaggccaggcacaggcagcctggcagagcacttaacatacctcccagaggacaagataagacctcagggtcagagagacagacaaggagagagaaaggaaaagtgagcacagaattcacctgaacacctcaggcaggaaactgtcccgagctccctttggggagagccagacagtgcttctgagtgaggacacatcagagtaggaaagtatgggactattatcagaaaaaatcctaacagtgaaagctggaaaaccccctgaaggcctttattaagtcacactgcaaatatcattatgtatttatttgacatccatttaacaaaagtagctatgtaaagtggctttttgaattctaagctggctttcccctgcatatatctggatctggtaatagtaaacaaataataatacattgcccagatcatcatcccacccactccggtgcttccaaattataattcccacctattaaacacccatgaagtgccaaacctagattaggcattttatacacttataagttagttgtgacaacaatccttcaaaataaatattattctccttctagatctggaagaaactgaggctcagagaggtaacaagctcccacagatggtctaagtggcagagccaggatttgaacccaagtctgtcaaacttaatactctgtcccaaggggtttgccagtaagtggaagtacagtactagatccatgactcccaactccacacttctatgaagtctgacaattttcaaggaacttctggttgaacctaggaatctactttgggctgccaagagataaagctggagtatgcaaacattaggctaagaaatgttagttgggcacagtggcttacgcctataatcgcagcactttgggaggctgaggcgggtggatcacctgagtgaggctggagttcgagaccagcctggccaacatggtggaaaccctgtctctactaaaagtataaaaattagctgggcgtggtggcgggcacctgtagtctcagctactggggaggctgaggcacaagaatctcttgaacctgggagtcagaggctgtggtgagccaaaattgtgccactgcattctagcctgggtgacagagcaagattctgtcaaaaaaaaaaaaaaaaggaaggagaagaaagaaggaaagaaggaaggaaggaaggaaggaaggaaggaaagaaagaaagaaagaaagaaagaaagaaagaaagaaagaaagaaagaaagaaagaaagaaagaaagaaagaaaaagaaatgtgactctctggattccaaatgactccttgattcttcctccctgctgctgggttagcacttactcccattactcctatcgcccctgaagtacaggcggggtgctcagtaacctcccagaactaatcaaggactcaattcataaggacttttactatactgctataacttgatgaaaatttatgagaaattcaaaattgtcaaatatggtgagaaggagatgttttcactcaacaaatatttattgagtgccttttatgagctaagcccttgggcatcaaagatcctcaagagaaactttcaccctgttagggtaaagagacctcaaaaaacaaaggcagttcagtatgtgaagcacaacaaccaagttaactttgaaggatggtggcagcctagaaggaagggtggcatcagggagggaagatgcaaagaagggctggcctctaatttgaggtttaggggttgaattcaccaggcaggtagagggagaatagcatttctagtggggagaacagcatttctagtggtgagaacagcagaagcacgggcacagaggcatgaaaatgcatggcatgttgaaggaagccagttttttcttaacctcattaaaatcatctgaccaacaaatatataccttatttcctcctttctaagttaagaggaaaaaaatcagtaaagagctagagtatttggagaagaaatgtcactgaggtcactccatggacatgatttggacccctgacatcattttaacagtggggtttggggatttccatatactgtttttacatcacttgcctgcctcccaaacaacccccctactttaacaagcagcagctgctcatccttctatcacagacatgcagcccctgagcttccagagtagctgtccctgccagctgtaagcagggaagtcagaagcatagaaatgaagaagcaaccaaagctctgcccaagatacaatttcaaagcagctcatctttcttaggagacctgccaaataggttggccctgacccattaaagagacaggcagacccattaactctatggttcacttgtcctgctgtccagactgcactcagcctgctttcctgtcaatccacatatgtgctatctcagcagaggggactaacatttatcaagcagctattgttttatgttatcttactatacctattttttgttttaatagaagcagcaggctcagagaggctaaggaacttgcccaaggtcacaaagctagtcagtatgtgaataaggattaaagcctaggtcagtgtgtctctgaattgtatattctctacagtatattaataacatcctaccaggtacttttgggagtttacatgtgtgcatatacaagctcatctattgctgctggaaatttgagtacattgccagggtggcatacgtgtcagagaatcatgggtgcatgtaatagtgacattacactgcagtaatagtggcctgcagtaatagtgacattgatgcccacaggataggacctgtgatcagaacacaacaatgaaaagttgtgtcttgtgtaagtccagatttgatagaaaaggaaagaaaaaatgtattgtctgtcaaaatggtatgttcttataaggaaatacacaaacatgaaggcagaacacaataaaaaacaactgggaaagaaaaaaggaaagaaacataagttttctcatttgttgagctgattcaattcaataggcatttattcaggacagactatgtgttccaagaacaggggatataaagatgaataagacaattatcacttcaagaaactttcagtctatcccggatactgactcagaaactgtaatccaataaaataagtgtacttaggattcaaagaaaaaacacttatgagggagcaaataattcaatccatagggacttttactatactgctataacctaactaaaattcatgaggttgggggcgtgatggcttatgtctataatcctagtattctgggaggctgagatgggaggatcacttgtgcccaggagtttgagaccagcctaggcaacatagtgagaccactgtctcttaaaaaaatatttttttccacgagaaaacatcacagggaaggtgacttttaatctggtctaaaaagatgagtaggttttccccagctagaggagggcattccaggaagaaagaacagattgtaaagtcagtcccagaagtaaaacaaaatacgtggcatattctggtaacagagaacagcttgttgtaggtgaatcaaaaggagcagcagacaagaggcaggcgaggcaggcgggggccatcttatgaagtcaccagagtcaacaagtgtggtcatgaactcagcctggtcttcaaactgtttgttacttgtccatgctggttcatgctggggtaaggacagaaattgtgactttagacattttttatagcaatttcacagagaaactatggcctttgaactaacaaaaattctgggtttgtatagcatatttttaaatctatatgggtttatttcattttcctagtgttgggtctgtgatgaattgaggggaaaaaagctggttcttcaccacatacagtttgagaaacactgagcttggggttaacactttcctagtatagatactaaaatagaacagaggcataattttatgctctggacacatagtgtcaagttgaacttaagcagacactattggttgtcttccatagccatttcccctttttcttcagtttatgcaaatctaattttgcttgggtaatatgttaaggaaggtgggcttttccccaagttgccagagcctgaactaagattggttgaagccaagcacaatatctcattccccttgatagcgactggcacaaaagtagacctgtgagcaatgagatgtaagaggaagtacgtgggggagcttctgggaaaaagtatactccctggtagatagcaggcctacctttcatccaggcttgaatagttgcgtgacgatgtaatgcttgaagttaccatagtcatgagataggatatgcctaaggatgagaagggtaaagagcagaaaaatagaacaagcctaggtttttttgtttgcttgcttttttaagacagggccttgctctgtcagccaggctggaatgcagcggcacaatcacggctcactgcagcctcagtcctctgggttcaagcgatcttctcaccccagcctcccaagtaactgaactacaggcatgtaccaccatgccgagctaatgtttttattttctgtagagacaggttctcactatgttgcccaggccagtcttgaactccaggattcaagcaatcctctggcctcagtctcccaaagtgctgggattacaggcatgagccaccacacccagccaagactaagttcttgaaagcaccactgagccactatctcaaaccaggagcttttaatttccaaacttcctaacagggaggtaaattacttttctgtattgcttgtgtcagtgtagttgggtattctactgcttccagttgaaagcatcctaattcagatctcactaaggacaactcttcagggaacagttctctgaacatctgctaattgtcacattctataaaaactgaacatcagaattattttgctctaccaataattttctttctaaagtttgagcaaactatgagaggaattcctccataaactcaatttgactgttcagggtgacctgttaggtgaacaagatggtgtagtggaaatctggttgtctattcaatatccatttacctcttcctcaattgtgacggaatttgttttgtccagatatcaaacctgcacatggatctaagcaggggtgggatgaagggggcggatcttgtgtaagccaatcagcataaggtattctgttgataactattactggtccataaaaatacatataacctaatttggctcaatcagacctttaaaaaggggactaagagtccatgcccagggaatggtttctctctcttccgctggactttaacaagcaagcacatgacgggcttcatcagtcctggacgagaaagctgagatgaaaataacttgagtcttggatgaaatcagtgaccctatgatatcatcacatctagagctgactctaactggacttccagctatgtgagttttccttatgaggattttctattacttgctatcaaaagcaccataattgacatagatggaatatctagcagtttttaatacctaaagaaataaacgctgggcataatcacacatgcactgtttaggaaagcatcttggaatatccaccataccactgagcattcaactttatatttctacggtttatatacatatatccactagactataagctctttgagggtagagtctatgtcttactactctttactactctgtatagttggcatatagtatgtcctcagtaagtgatgaatcaaatagcctctcatcttgaaaaacgtgtctgattcacacatgaattatcaacactagggctgttccctgcaaataatagaccttcactaagtatgcattaagtgaatttataactacaaatacatgatgtttatactggataactagtacaccaaagaacaccgggcttcaacttacctcgcaggttaccagctattggatcagggtgatttccttatcctctccaagcacctatactcacctgtaaaataaggaccatggtttttccatcacatcataggtcatattagacctatgaaagacatagtattcccaagataggccttacttaaggatatgatcctgttttcatcaaccttcaagtcaaacatttcaaggttagacaaacgggggactagagagaatagtgtgaatatatccgtattgagttgtcattattgtgaagagcaagggcttagcaaagaggtgcattagaatgtggttgttacccactaggaggccaagttcttcacttttcaagtgactgtggtgatatctcttttcattattaccgaaatgctgtacctcatctttgggaagacttaagcactaggaaagggtgggcagagggtcttgtgagatgtacttttaagtgttgcagaggccaaaaagggtgctttcagttcccttacaaatcaggcaagcataccaaactggcaaaagtttaaaaaaattgtgttgctcagagattaatcagtgctctcagacactaaggtgtaaatggatatattttttctagagatcacttgggggcagtcctcactcaaagccttgaaaacacgcatggcctctggcccatccttagctgaagtgattagtaaaggacacttgtaaagactttccataaggagacttctattgcagtgttatcagagtagccaaaaaaaaaaaaagaaagtaaaaggtgtacacacacacacacacacacacacacacacacacacacacagagagagagagacagaggtgagaatgtcatcgaagagaggtcctattgtagactgatgggatttcagatttcttccttattatgtttccattaaaccaaccaacaaaataaaacaaacaaaaattcggaatttaggttatctgacatatatcctgttccagactgagacccaattcctagaacggcatctgacatacagaaggcactctatatgaagtatttgtttaatgaatgaatgtccaaatgcgcaaaaagaaaaaatagggtattggttaaattatggttaagtcacagatgaatttatacatagtcaatacaaatgacaccacagacctatactcactgatggtaaaataccttaggggcaaaacatgataatgttataacctcattaaaaatatgtagcatagaaaaaaaattttattttgttttaaaaaatgtataaaggcataggaaaagtctagactagtatatatcagaaattaacaatgggtgataaggttatcgatttttttgttttcttttttgcagttccaggacatattcaagcagagtttggataaccacctgccaaagatctgtattgggtgggaagttggttcatacctgtcttaattgtccaagattctattcttcacctagattatctctgtaaatcatgaagtgcttactaaaagtattatatccaaatgaatattcaagtaaaaatataaacaataaaataatagagaatgctaataacagtgctaaatactgtgtatacatcatttttaattagtactgacaatctcgtaagttaggtattacttctatacctttttttttttttcagctgagaaaaacagacccaaagaagctatgccttgcttgaggtcacatagccagctattgaacctaagtctgtcatacatcaaagccatgctcttaatgaattaggaaagaatcttaaggaatcatctgattcagctccttattttataaaggagggacttttcccatcacacaatgatacatgaacattatacatcctcttaattatgttctcagtatcttttgttcttgagattttagactcaatgtacttacaagcagaatatgatcatacttcattagcccatcagcagctacgaggatgacaaggttgctatactaaggaaatcacactctgttcaactccaggcatcaccatggcatagcactgagctgtttgattagtgacatttaataccaattcagtctctagcctaattaatttctaattaattctaatttctaattagtttctaattaataagagacaactgtctaccctgtaggcacgaaacttaagatcctagtctattttaaaatgtaactacccatgtacagattcataatgccaaacagttgagatcttctaagccaaattaccctaatctggtccaaaatctaaactaacttttccaaaagacagctagtaaagaataacaataatggtttaaataataagactaaaggcttgttcttacctttaagaaagttaaaaaaaaaaaaaaaaagagtgttgaatgagatgatatggctaccacactgattctgaattggtaaagggttattttacttctatgcacctaattctggagatttcattggttgaggtcagtatctgctttctcctgacaacagatatccagagttcccagaatgacatagtaataagaacataagaaccttatgttacaagatttgttggtatatatcctttgggggaaaaagccacgtgagcaaatgaggaacacaaaaaagaaacacaactgaagatcttccactagtaatattttactttcttcttacaataaattataaatactttttccacatatcaaagttcgtcaaagaactcccaaaattaatcttcttcattcttcaggaattatttattcacacagcagaccacctacagaaaaatatttattttagaaagtcagatttcaaacatcatgccagatctatggagtcagggaattaagaccactagaaatgaatgcctcagatgagtaattaactaattgccagaattattccaaatcagtcataaaattcaaaatcaacattttaaaattctaggtttgcctaactaaaaacattagtgaaattattcatgatattatttactctttaaaagtttttgaagtaaaaactctctctgcgtgtatatatatataatacatatgtgtgtgtttgagaaatacatatttctcaaaaatatcctccaaaaaaggctaaagcagttatttttacagatattcaagaaacaagacctgcaaacccctctttgctgattcaagtatgcctggcgaagatccacaaagtagaaggcagaaggtcagctcagtacccaaggcacttcctgtggaaagttactcacttaatcccaaaggcaagacaagggcaaccctttaatattcatttggaaaaatcaaaaagggagagtagcatagatagggttgctgatccagtcaagtcaataccaggcttctcacacctctcccagtgcctatcccagaagattgagaacaatgctaggaaggtaattaaattggggtagctaactcttcaagtctaatgcaaatatttccttcatttagctgttcacttcatttggtttaaataaagataaaccacatcaagatacaaacatctaaactcttttctaaaagactcaaaggaagaatacatttatagaaaagtttggaaagataaccaaaaacgaagccattcaacctttcaattatagcagcccatagcattgttacgacttttgcgactgactacataacaaaaggggctgtgtggtggaagaccctggatttaaacctgtttgattatatctctggatgtaaagtctttgactggagggataatctttctctcctcagtattttccagggtcttaataaatatctgctgaatgaacaaatgtttgaatggcagaaattattctttctggattatcttgggatattttcatacatgatcagttttgtgtgtgtgtgtgtgtgtgtgtgtgtgtgtgtgtacaattcagcatattttaagcatccaactgttaagttgttaaacttaatattgagtatcaccactattcagtactagtcctttaatttctttcaacgactttagtctccaaaataggttctttaggcttcttctgtctcctaaaggcaggaagatagtagccatctatttcctcatatttctaatgaggttctaggttcttctaattactcttttcagtaaaagcagcagtcataaaatagaaaaaaattgtctaaaatcaccaccatacctattttttcttgagttttcaagtctctgcctttgctactactaaattttcagatactttatgcctagcattatccctgctattcatcttcaacttaggccagtggttgttaaagaggagtgcacttgaaaatcatctaggagtttctcagtcaacaggtgcagaccagggcccaagttgtgaattctggaaaacattcttcagatgattctgaggtgcacctctgggtaagaaccactgggtgaatgtagcctactttcaggtaaggtataaaaaatgtataatagatttattcccaatctactgcacttgaggtacaattaagatctacttaggaataacattaaaatctacaaaggtttttgaattaaggaactttcatgatcgttgccagagagatctaagtttgcaaaatatttttcctttgaagctattctcagaaaaatgtgatctaacagtctaagaaataccgatttaggttaagtttatcttatagcaatgcagacagttgtgttggatttcaccctccagccaatggcctgtttactgggttatatgcaactgtacatttccgcaacaagtctttctaattagcattcataatgaggttttaagattgaagatcaagattatgtgcaatcctaaaaatgaatatgttggaataaaatctcattaagtacaaggcgtgaagtgtaaagtgcctgtgatttagagaatataaaaatcttaactctaatctaattctaccactatccactcctaacttgagcaagtcttttttgacttcactgtgcttccatttccccatggaggttggggaaataggacacctgggaccaataaggatccaacacccagtcctcttcccaaaatattattacactgaaaatgaaaaacatggcagtttgaattctcagaagggtcctatatggattcagattgttcttcttgtaaccaggattcaataataatcaagtcatatacttaacagacctcaactgaatgtctgctatccacaactctaaaggtatgagctattctgttctggtttttacagatgatttattttacattgaatcatcacaactctatgaagtagtttgggcatgtattattgtctccattttacggatgaggaaaccaaggtacagaaagttaaggacctgcccaagaccacacaatcagttaagcagtagattttctaagtctaaagcttttgcattttcttttacacacaaatgaagtacacaaacataattctcactctctgccctgataacataaagaaaactatgatatcatatgatacttttgaatatatgccacttataacaattgtaccacctttgtggttcagatgaagtccaagataagcttttgatattcctaaaattagcatttctttttatttaatcacccctttttatcaaggcaagttcagcacaagcctacagcttacacaactgacgagggagttagatcatgaacaaggaaaccatgtacaaatgttaaggttgcatctttaaaaatagttaataaagtacacatactttttaagaacacactccccttcaaatttacttattttataaaatagttcattatgggatttctttaaataaccatctattctaaaagcaacttaagtatatcatttacacaacagtagatataccatactatatatagaatcacaaaatgtattatggttctctttttataaataataagtgaaattcagaggagtaatgtcttgatgaagctaaatgtagctaaacttaaaaacatgataaactaaacatcaggagaataaaaacaaagcctcaggactttcagcctagactgttttccattacacagtaacttcttatcagcttgcgacaagttccttatccctccttttttatagctcagtgaggaagactggccatatgtgaaattccaaagaggcaggaaagaggtgcaagggaaagaagccaggctctctagtactaatatattggcatatggctttggcattctctctcagctgttattaagttaaaagtggtagtgtggtgtggaagttagggtaggggcaaaaagcagagggaatcggcatggagactgaggctccagttctgatactgcacaacccaccttgggggccatttcataactataagctttaatttccttatttattcattcatttaacaatcctccattaagcacctactatgagccaggcactgttataggtagtggggatatgacagtaaatgaaatagaaaattcctactttctcagagcttacattctagctgccgtgaagcaacacaggtaattaaaaatatatgtatcatgcaggtgacagtgtatagaatagagtagccactagccacatgtagctattaaaatttttacaaactaaaaattcagtacctcactctcaccagccacaattcaagtgctcaacagccacatatggctagtggctaccagactggcaagtgcagatacagagcatttccatcttcacagaaaggtcttaggacagcaccatgatagagtgatggggaagggatgtaatttacatggggtgttgagggaaagcctctctaataaggagacttttgaaagagacctgagtaaagagggagtggggtgagggggtgagctaagttgataactgaagaaagagcttccaaacaaaagagtatcatttgtttgtggaattgttggacacataccacttaaggtccctttcagcacttaaaatgggttaagagttccaagttcttttaaaaatggcctgaggcccaccgccctgtctgggatgtcaggagtgccactgcccggctgcccactgtctgggaagtgaggagtacctctgtccggccaccccgtctgggaagtgaggtgcctctccgcctggccaccaccccatctgggaagtgaggtgcccctctgcccggctgctgccccgtctgggaagtgaggagcgcctctgcccagctgctgccccgtctgggatgtgaggagcgcctctgcccagctgccgccctgtctgggatgtgaggagcgcctctgcctggccgccccaccgtctgggaagtgtggagcgtctctgcccagctgcccactgtctgggaagtgaggagtgcctcggcccggcttctgccctgtctgggaagtgaagagcaccactgcccggctgccccacgtctgggaagtgaggagcacctctgcccggccgctgtgcaaccttccaagtgtgaagtgacagccttgtgtgtgatcttttctgtcttccccaagtttgcatttttgacattaaagtttactttttaattaaaaaaaaaatggcctgaggctttagttttattcgaataaagcatgctacaattccattttcatttttcagaaagcaatacttccgtgggatacccactccctacttaaaagcatttcttggccaggcatagtggctcacacctcttaatcccagcactttgggagaccaaggcaggaggattgcctgagtccaagaggttgagaccagcctgggcaagatggtgaaaccccatctctaaaaaacaacacaaaaaattagccaggcacggtggcccacacctgtagtcccagttacttaggaggctgaggggaggatcacctgaacctcccaggttgaggctgcaatgagctgtgattgggccacttcaccccagcctgggtaacagagtgagaccctgtctcaaaaaaaaaaaaaaaaaagcatttactgaagtcccacaatatttattagaaacaagaaagagaatatgtttcttttagttccctcagtcaattttcctaaagccatgggacctaaaggcttttgtcaaaccctttcttaaaagctcaattctccccttccccaatccgctaaatgactgtctttactgacataatttactcccttcattgggaactgaaaaatcatggttttttcaaattgatacttaagcattttagattaaccaggtgaactacctttcagagagaatgtagcccaattgttgctaaatctgtaaagcaatacacaactttgaagcaagaagcttaccatttcatattttaaatcctagggctctcatgcattccttgtgggcctcaattagatgtccacagtgttcttctcctttctcgatgatactataaaacaaaatgtacttgttatctaaatatgcattaagcacattattaagtatgcatgatagtgatggggagtgagacaaaacacgggtataatggaatgtagctggaattaaaacaaacgctattacctcaaacagctttgtttttatttgatcttatgatatgcccatgcctatgaagacattccacagataagtgattttgggggggaaatctgataagaaataatcacgcatattaaatattgcctctagtcaatatccaaggagtaacactgctctataaagaaataaactgagtaaaatatttatgctaaatgaagggcacagagaacagctcaattttttgcttattatcacagagaaattaactttctgattttgccctacattcaaacacaaccaaataaatctacttctaattacatcaaaaacatctggtagccaggagaccgagataaacaccccctcatgatgatcaaagaatattttacttgtaaaattcacaaagtaaagactaggactacacagctttatttctaaggcctgaaaatgtgattttgcaaataatcaagttaagcccaattcaattacaaggaaaaactgactcctgactatggatatttggggagaacccacgtggtctgaggcaatcgaggcaaagggaatttaacaaagggaataggttctccttccatggaaactctacccatccttcaatagctcaagagctgcctgcaaatgggagattgcctgggatagtgagatcattgtgaagataatagctagcattcattgatcatttattgccatgtatactgtgttagccacttgacatggcttgtatcattaacctttacaataatactggagggagtttcttttattagagtcattttacagacacatgaggctcaaggtcaccaagttagtggattaagattcaaaccttgactgtggatcccagactcttaatcatgctgtcataccattcaaggttcaacagcacttactgttaccactggaacaatttgttcagactagtctttcaatcctacccgtattatttacaaagtactgaggattaataaaagcactgagctcctacactcttattatcccattataccactaatgatttctttcttatatctactatctgggaagacaaaaggggccagaggaagagatgcacattcacgttatctgaggacgtcctctaatgagatttgctccacaagagaggctatataaaatgagaacaaatcttttgtggattgacaatctagatgaactattcttaatactttgtcccctgcgtcgtagactgattgattttcaacttttggttgtcttaaaagggttgaagcgtaactcttcagaactgtaaggaatacactctgtgtcctactgtctctaaattttgggagaaagccttagaaattaccagaaaacctttcctgtttggtcttaacaaatctatcatagcccttaccacgtcgtatacaagtcactggtttatgtctccattaactttaagctcctttatatcaagatgcatctttatccatgtctacatcttcggacctaacgcagtgcttaacccataacagatactcaacacacatttgtaggaaggaatgagtggttgaagcttgccgttctcctctctctccatcgtttcccggtactaagctacgggataagtcaacagagacccgaccacgaaacctacaaggcccaataattatctccagagcgccgcaatggggcggggcggggcggggcggggggggggggcagacagggaggaggagtgggggaaggggggaaggaagagggcagagggcagaaggcagagggcagagggcagaaggcagagggcagaggccgtagggcagaggcaccggaaggcacaggccgcggcccggggctcgtcggccgcgccctctccggctgcgcactgaccacgcatcgcgcgccttcttggtctccgggcaagcgcagcagggcttcagcggcttcttctcctgagactcaggcggggcagggtttgagtcaaccagacccggcatctttcgcgccaaaagcagctatgagcggagacagccaaatctatgccagcctcggcaaacgccgattcgtccgcagtcacttccggcagtcgctctaaaaagtacaggaagtcctgcttctctctgacaggtggggaatttaaaaggagcgcgtgcgcagaagaggcaaaattcgggccttaacgagagggtgcccccttcagcgcatgcgcaaggaggcccgctgaacgctcacctggactgtggtatttacactctaggactctaggtcatagagtatttgttaaatcaacttggggagggctcacgaagaaagaaagcagcaagacaactgagagatctcgtaacacccgctcctccccacccaatatcgaaacggaagcccaagatggtgaaatgatttgttcaagccaaacaggagaaaccataagtgaaagccagttcccttgaataacagactagtttcccccttttcttttatccgccttcttcctgatccccacacactgcaggcctttcctctctttcattgacctatttaaaaatgaatagcaagacatagaaccaccgagtccacaactattgggggaatttaaaaggtcctataaccccctatacacctcctacgcacattaaatcctcagctaatttgcatttatagcccccctccaactgatctgaattcagtatgaattattcagtcatatattcgttaatatactgatgaataaaattgaaaaataccatttccatagcatttcctcaggtacatagataaactggtgcccgtcttattcgcaatgaaatggatataatcattggatttttttcctgcagagtattgttggaaacaggcaataaactcttttttattttattttattttattttttggagatagggtcttgctctgtcgcccaggctggagtgaagtggcacgatcttggctgactgcaacctccacctcctgggttcaagcaattctcctgcctcagcctcctgagtagctgggattacaggtgtgcaccaccacgcccgagtaatttttgcattttttagtagagacggggtttcgccatgctggccaggctggtctcgaactctgacctcaggtgatccgcccacatcagcctccaaaagtgctaggttataggcatgagccaccgcgcctggccaataaaatcattttttaaagcaggacttggaggcactgttcaatagctgcagggtgataggtatttttaggtacttaaactttcagcatcacctaatcaaagtttgtttctatattatagatatttaactcagggaatttacaggcgtgtctgtgaactggtgctgtataagagtaatttctatatgtgtatttttcaggttactaagaccatccccattttgtcatctgaaaactttcaataaggatgatttttatttccttctggattgatatttttaataatacaacatattaccctcatgttctaaattcaccctcatccattattatcaattctttcaactaggtgctaactcacattgtttagaatcttgctaatcaaacagtgcttcctggatgagcaatatcaacatcacttgtaaccttaatatacaataaaatgtggttcaacaaattattggggaaaagaaaataggctaaccatctggagaaaattaaacactacattaaaaggaagagctctagatgcattaaagacctagattggaaagattgaaatatgaaattaatagcaaattgtggaggagaatattttaatactgagggatgggggaataacttatgttacatttcaaaagtacaaattgcatgtcaaaaaaattgaagaaattcattacagcaaaataaaggcttggggttttacatacaatactatagacaaagttaacaaataaatgatagaattgggagaaaatatttgaaatctacatatttttaaaaattttaaaagttaaaaaactaatgtgttcacttagaatatgtattcagttgaaacaatgtcaccttcagtcgcaatatcttccatatatgtagggctgtcgaggttgtgaaccatcatttaatcttcatggcagtcaaaattattatctacatttatagttggggaaaaattgaagttcagaggtgtacatttgttcaaggctgcgtaacttgaaagtggcaatcctgagtctcatcatcttctccctgtactctgtctactatcctacttaatttatctaaatgcaaggcaaggcctggtgtagtggctcacacctgtaatcccacactttgggaggctaaggcaggcagatcatctgaggtcagaagtttgagaccagcccaaccaacatggtgaaaacccatttctactaaaaatacaaaaattagccaggagtggtaacctgtaattccagctacttggggggatgaggcatgagaatcacctgaacccagtgggtggcaatttcagtgagccgagattgtgccactgcactccaacttgggtgatgtagtgagactgtctcaaaaaaaattaattaattaatgcaaagcaaaatttttttattttaaaactaatcattgatctgtattcacttgtgctattgcatttttatgtataggaaatgaacaaggaagaaaaggaagataaatatctaacagagtttagagagctaagagaattgagataaacagtagggacagataacagacccaaagactcaaacagcttttctgcaattgagaagattttttggcccactgtccctccttgcttcagggaagaaagattactggttgtgataacactgcctgtgacttcctcaggttagctaatataggcaggcctcaggcaaagaagttgagtagcagccctttctgcaccacacttctttaacctgctgtgttccagacatttacaacctttggtttccttactgagtgctgtaacccttaacactctttcaacaactgcttcttcaggatgaaatattctcctgactttgaaaaaaacaaccagtggcctttccaaagtgaaatatttagtcatttatatctagctactaaactatcctcttgcttcagaatggtacagctaacccacatatgtgggttacttttccttctaccttttaatttatatgaagtaaggtggagcgtgctggctcacgcctgtaatcccaagcactttgggaggctgaggtgggcagatcacttgaggtcaggagtttgagaccagcctgaccaacatggtgaaaccccgtttctactaaaaatacaaaaattagccagtcgtggtggcaggcgccggtaatcccaactactcaggaggctgaggcaggagaatcccttgaaccagggaggcggaggttgcagtgagccgagatcacgtcactgcactccagcctaggcaacagagtgagactttgtctcaaaataataataataataatttatataaagtaagctgtaaggtcaacttttgatttttatgttatcactatgcttttcttctttctctatcattttttcttctcctacccagtctaaatgcttttatactcgtgggatggcctgtttcggtattaaaggaaaggtaggagtatataacataagaaatttatcctttcccattctaccccaacaaaaatcttaatagcccacttcccccaagaaaaataattttagagagctgtaattagagtttaaattgacagtaggtggctgatgaataccaaataataaaagataaaattcacccatctgtcttacaaaggcaactctgaaattagtttgattcataccttttatatcaagctcttgctcatcaattttgattttaaccagaattggagctcttttaaacctttggaatgctttgctattactataattgctaaattagcaggcattaagacttgaagtggtgactgtagtggattttttcatagcacagtgaatatgtttattgtatgttattgaatggggacattagctaccagtggcaccaaacagcaattttgtggatgcatgacagccctggtaatgccagaagcaacaactgagaaagtactttctaaaatccttctatgataaaggtatttttagccatttttcaggcctaactaatcccaggtgtgccagctttaccaagtaagggtgagtagttgttggtggagaaggagtgacaccatatgttgagagataagaattacaagacttaaattctcattggcctaatgtactatgtctactttgtataaactaacttacaaaagtaagtaaggtaatttttgtccttatatctgcccctgcaaaggaaaaaatgctttccaatttccacaggtaaatatgtactgtacatcgttctttatagctgcaattttattcaaattgcctgccacagttttatgaatgttggttgtattagtctgttctcatgctgctataaagaaatacccaagactgggtaatataaaggaaagaggtttaattgactcacagttctgcattgctagggaggctccaggagacttacaatcatggtggaaggcaaatgagaagcagggaccttctttacaagatggtaggacggagtgagtgccaacaggggaaatgccacttataaaaccatcagatcatgtgagactcactcactatcacaagaacagcatgggagaaactgcccccatgatccagttacctccacctggttccacccttgacacatagggattacaattcaagatgagattttcagtggggacacagccaaaccatattattggtagaagcctccaagcagctaggtcacagatgaaggacaatttattacttatagcaatagcagcagcagaatatcagcatttttatgccagttccctgagttccaagtcccacagggtgatgtgaagaaagccagatgatatccacatatgcactgggttgaattacaggaaaggaacagtgagcttaggaaactcaaatctttagttgtgggcagtaaaaatgtctgacttttgctcccaaagtagacactacctttgtcttccaaggttgtttcctacacaaaggaacaaaggcaaacagtgccaccccttgaaagacatgcagaaggccgggcacggtggctcacacctgtaatcccagcactttgggaggccaaggtgagcagatcacgaggtcaagagatcgagactatcctggccaacatggtgaaaccccatctctactaaaaataccaaaattagctgggcatggtggcacatgcctgtagtcccagctacttgggaggctgaggcaggagaatcacttgaacctgggacgcggagattgcagtgagccgagatcacaccactgcactccagcctggcgacagagcgagactccatctcaagaaaaaaaaaaagacacgcagaaacatgtgcacccatggagaattatctcccaacattactatgtacttcgttttaattaaattttatgaactaacatccctttccaatatcaaagttattttaatacaagtaacctaaatgacatgacctgatttcacgaaggttgtgtattagtgatttattgctattactatggactgaatgtttgtgtcctgccataatttatatactgaaaccgtaatccccagtgtgatgatatttgaagatggagcctttgggagacaagtaggtttagatgatgtcatgaagatggagcccccatgatggtattagtacccttataacaagaggaagagaccagagtccttttgttgtacccatgtgtggatacaacaagaaggcagcactctgcaagtcagaagtaaagccaggatccttgccaggtactgaattgaccggcaccttgatctaggacttcccagcttccagaactgtgaaaaataaatatctgttgcttaagccacccagtctatggtattttgttattgcaacccaaggagactaatacagctgtataacaatattaccacatacctggtggtaatacatatttattatctcacagtttctgtagtcaagggcattacttaagtgacttctttgattagggtcttacaagacttgaatcaagctttcagctgagactgtggtctcatctgtggttctactggggaagaatatgcttccaatcttatgttgttgacagaattcagtttcttgctattgtaggactaaaggctttggtttcttgctggctatcagttggaggctaccctcagctcctagaggcctcctgtagttccttgccaaatagggttcccaacatggtcacttacttcctcaaagccagcaagggatagagagccacccagaaatatgggcattacagtcttatgtaagagaaccatgtaattacatctatcatatcatatttggcatattctattggctaaaatacttgaaaagaggggatcacatgagaacatgaacaccaggaggtcaggatccaggggccaccttaagaatctgtctaccacaggtcgattatctaaagtgaaaaattgattatacaaatggagtcattcctgttatacccaactaaaatttagagttagaggaccataggggtgaaaaaacactcaggtctcaaaagcctgctccagaaactgtcccacaagcccaatccaatgaaacagctgctacaattttaagactagtttgacaacaaatggctgccatgacttcaaagcttgttttacctagtaacttttgccacccagcaatcagagcttgccagctcctgcaaaatgccacaagcaccaataacctttctcttttcccaatgaaacctcaaccatttccttttttttttttgaatatattggagaccacttcagtttgtatgtttgtcccagattgcaatcctatttctttgtttatttcaaaataaactctttttgcttggagattagtctctatctgttattgacattacatggtgtcagaagtgagatgcaaagcagattcacttggaaagataatggcccctggaactatggtgtgcagtactcactgtcagaccccttgagccccctacttccgctggtgatcttttttcaccccagtgagtctttcttgggttaaacaccccttttttttttttttttttttttggatttgagttcttcagctttatttgggatttctttatgaagggcctttcctctcctatttattaggcctctatttgtaagggatttgaagaaggctttgtcattcttcccggtgagtatgtactttactctttggttcattttgtgtgcttgatttttattttggcttttgtgtgtttggctttgcactgactcacttggatatgtttatttacaaatgaactccccaaattcaaagatataccaaaatagccccccaacattggggactctagcttgttatatgcttaattattatggtccatcttcctattctttttttatcgcaatggaccaattacactaaagaaaatttggaattacaatggccatctcttgaactccctaacttgttttcttagaactaaattagaaggccatggctacaaaattaaattgcctgaaaggagcataaactttaagtggtatcttgaagcatctaaatgtattcaagcctcaaaaatcacctaactccaaaataccatcactaagttaactaagacagataaacaacgaaaggaagattttaaaaggccttagaaactcagagtttttctgctcccctggtaccaccacctctctctcctctctacccttccctttctgaaaaccccactcaatcctgatacttcctcccctactaccctcccagcttctgatccccatcctcaacctataaaaacttgtccctgtagggttagacccactaacaatcctgaggttccttagattgtctatgcccttggaataaggctgaaatccatgttaaagccaaggaatttcctaaagttacccaggaccctctttgctttgctgatgaatttaacattacaattgaagcttactagcccagcttctctgatcttaatcaacttgtccacatgcttgtgggagaaagccaggctaatcactggatgaaaaaggtcagttgtggctgggtatggtggctcacgcctgtaatccccacaatttgggaggctgaggtgggcagattacctgaggtcaggagatcgagaccagcctggccaacagggcgaaactccgtctctactaaaaatacaaaaattagccaggcctggtggcacacatctataatctcagctactcaggaagctgagggagagtcatttgaacccaggaggcggaggttgcagtgagccgaggtcactccattgcactccagcctgggtgataaagtgagaccctgccttaaaaaaaaaaaaaaaaaaaggaaagaaagaagaaaaaggtcaattgcacacaccctgtattagtctgttttcatgctgctgataaagacatacccaagaaggggcaatttacaaaagaaagaggtttaattggcctttggccttacagttccacatggctggggaagcctcacaatcatggtggaaggcaaggaggagcaagacccatcttacatggatggcagcaggcaaagagaatgaggaagatgcaaaagtggaaacccctgataaaaccatcagatcttgtgagacttattctctaccacaagaacagtatgggggaaaccatccccgtgattcaattgtctcccactgggtccctccacaacatgtgggaattatggaagtataattcaagatgagatttgggtggggacacagagccaaattatatcattttgcccctggcccttgtcaaatctcatatcctcacatttcaaaaccaatcatgccttcccaggagtcccccaaagtcttaactcatttcatctttaactcaaaaggccatggtccaaagtctcatctgagacaatgcaagtcccttctgcctatgagcctgtaaaatcaaaagcaagttagttatttcctagaaacaatgggaatacagacattgggtaaatacacctattccaaataggagaaattggccaaaacaaaaggactacagggcccatgcaagtttgaaatccagtggggcagtcaaatcttaaagctccagaatgatctcctttgactccatgtctcatatccaggtcatgctgatgcaagaggtaggttcccatggtcttgggcagctccacccctgtggctttgcagattacaacctccctcccggctactttcatgggctggtgttgagtgtctgcggcttttccaggtgcatggtgcaagttgtcggtagatctacaattctaggatctggaggacagtggccctcctctcacagctccactaagcaatgccctaagcagtgccccagtaggtgtaggggctccaaccccacctttcccttctgcattgccctagcagaggttctccatgagacccctgcccctgcagcaaacttctgcctgggcttccaggcatttccatacatattctgaaatctaggtaaaggttcccaaacctcaattcttgacttctgtgcaccctcaggctcaacaccacatggaagctgccaagacttggggttggccatctgaagccatggcctgagctctatgttggccctttcagccatggctggagtggctgggatgcagggcaccaagtccctaggttgcacacagcttggggaccctggacccagcccatgaaaccactttatcctcctaggcctccaagcctgtgatgagagtggctgccatgaagacctctgacatgccctggagacattttctccattgtcttgggaattaacatttggctcctggttacttaggcaaatttctgtcgttggcttgaatttcttttcagaaaatggtattttctttcctattgcattgtcaggctgcaaatttttcaaacttttatgctctgtttctcctttaaaactgaatgcctttaacagcacccaagtcacatcttgaatgctttgctgcttagaagtttcttccaccagacaccctaaatcatctctctcaagttcaaagttccacaaatctctaaggcaggggcaaaatgccaccagtgtctttgctaaaatataacaagaatcacctttactccagttcccaacaagttcctcacctccatctgagaccacctgaatctggatcttattgtccatattgctatcagcattttgggaaaagccattcaacaagtatccaggaagttcccaacttttccacattttcctgtcttctgagccctccaaactgttccaatctctgcctgttacccagttccaaagttgcttccacattttcaggtatcttctcagcagtatctcaccctggtaccaatttactatattagtccattttcatgcttctgataaagacatacccaagaagggacaatttacaaaagaaagaggtttaattgggcttacagttccacatggctggggaagcctcacaatcatggtggagggcaaggaggagcaagtcccatcttacatggatggctgcaggaaaagagagaatgaggaagatgcaaaagcagaaacccctgataaaaccatcagatcttatgagacttattcactaccacaagaacagtacgggggaaacttcccccacgatttaattatctcccaccagctccctcccacaacacatgggaattatgggactacaattcaagatgagatttgggtggggacacagagccaaaccatatcacacccctaacagaatttagaaagacccctcctcatctccctataaactagcttataatattgggagcaggaacggtaacttgcaaaaagtttatatagggccatccccaaagcattccgtaaagccattgactagaataaaattcaagcatgtacccaagaaccaaacgaaccagttcataactattataacagactccagattgtatttaaagagaattctggccttcccatggacattgactctactagagttgcctttaactttatgtttgttaatggtctctcctaacaatttactcagttagtaaaaaaagcttgcagggaatgaaaacccatgccaatcctttaccttgttaatttggcaaatcaattagatagcaccctagaggataccaataaaaagaagactacaaaaatcccaaacctccaattacaacaaatgaaaggtcccagagaaaacaattagggctctgaatggcaccactcctctaattcatgaaactcacctcctggcatccgtcattattgtaaacaacctggccacagcaagaaaaactgttataaatttaaccaatctaaatagtcttcttcatttagccctttgactcctgcctcctaatgaaagggatccaaaaatatacaggggctttttccaattcttcccctcaacctccttggcaatgaggtcctacctgttctcattgacacagaagcaaccctatcagtactcaatcccaccaacctaagccaggccttgccttggagttataaaattattcaaatagtaggagtttctaataaaccactgatggcatttcaagctcagcccattgctttttgccttgggtttttacaagatacctatccttttttactagcagaatctgctccagctaacttattgggatgagatttaaaaaaaatatatgtcatgttggcatctctttatccctaaagggggaaataattttggagtctgataagcccaatagcctgttgaactctaccaataatctcccactcatttgttatgttgtcccatgtactaaagaactctccactgagtctcagagttccctattggaacagaaaactgtctctttatcagccacatcatcaacagatgttggtagaattcataatgcaccctcaatcaaaatccaaattgattcaaccaagcctttgcctagtattaaacaatattccttaaccaaactgccttagacccaatattgaagaatacaaaactcaaggcctaataattccctgtatcagcccctaatacttccaccctcccagtaagaaaacctaattgttgaggatggagagttgttcaggatctccatgccataaataatattgttataccctgtcacctcatggtccaaaatatacatacttctgttcccaaatccacatactgctgacttctatacctactgatagtgaattttcactgttattgacctctgtagtgtcttcttcagcatccctgttgatcaaactagtcaatatctgtttgcctttacgtggaaaggacaacaatatacttggactgttttgcctcagggctatatggaaggcccttcctacttttctcaaattctgaaagctaatttacaaaatgtggcttttcttcaaggctcacccttactgaaatatgtaggtaatttatttctttgttctttctcacgcaggtagcctgtgagatagacagtgtgcatcttctaaaacttcttgccacaaaaaaatcataaggtttctaagaaaaaatataactatagttaagacccaagctaaatatctaggtcatctgacttcttgaacatgactacgtttgggccctgaacagatccaaggtgtcctgcagttccccaaatctaaaatgaaatggcaactcagagagtttcttagacttgctggatactgcagtaactggataccaaacttttacttaattgctcaacccctgtacaccctactcaagacctctaaaaccgatcccattgtttgagaagaatctaaaaatattgcatttactaaattaaagaaagaattattaaaccccccatactctgagacatcccaattatccactccttattttcctttttgtttatgaaaaaagggaaattccttgggcgtcttaactaaaaaaatcattgagagtaacactgcccccagtggatattacagccaataactagatccagcggcttggggattatgctcctgtttgggaactattccagctactgctctactagttatagctatagaataaataatcatgagatctcctttgaccacttttgttccccattctgttgaagctcttaaattcccatcatacccaacacctttctaccagttgtcttagcatttatgaacttcgtttactagctgctcctcacataactttctctctgtaacaatcttaatcctgcatctcaccccttctttctgatgaaaccccccatgagtgtttgaccctcactatcttttgattccccagaaagatttgcaatatagtccattggacaatgctgaactatcattgtttacaaatggatcatatttaaaggatgacactggcaaagagtgtgcaggatatgcaattattacctttttttgaagtatctgaggctagcttcctacctgtggctacttctgtcaaacaggctgagcttttgcccttacttgggcttgcctccttgctaaagggaaatctactaatctgtatttacaggcagtaggtatgctttcgaggttgctcatgatttggggatgttatggaaataataggtttcctcacttccatgggaggccaaattacaaatggatcctacacacaagacttactggatatcatctagctaccagctgctttggctattatctaattttctgtacattcaaatctacatttttatggagatgagagtaaaccgctttgctaataatgcagcaaagaatgctgccattaaaggttcatttgatcaaatctctgttatggccctactaaaagaactttcaacaaatgatttaagaataattatcaaagaggccaggcacagtggctcatggctgtgcactttgggaggccgaggcaggtggattgcttgagtccaggagttagagaccagcctgggcaacatgacaaaaccccatctctacaaaaaaacacactcaaaaaattatctgggcatggtggtgtgcttctgtagtctcagctactcagaaggctgaggtaggaggatctcctgagctcagggatgtagaagctgcagtgatccatgatcaagccactgcactccagcctgggtgacagaatgagacccagaaaaaaaaaaaagaacaattaccaaagatgcacagaattgggcctcagaagtcaaaaaacaaaactgaagtcaaaaaaacaaaacagggctgggcacagtggctcacaactgcaatcccagcattttgggaggctgaagtgagtggatcacctgaggtcatgagttcaagaccagcctggccaatatggcaaaactctgtcaaaatacaaaaaaattagataggcttggtggcatgcacctgtaatcctgggctactcaggaagctgaggcacaagaatcgcttgagcctggggagcagaggatgcagtgagccgagatcttgctacagcactctagtctgggcgacagagtgagactcctctgtctcaaacaaaacaaaacaaaacaaaacaaaacaggctgggtgtggtggctcacccctgtagtgcactttgagaggccaaggtgggagaattgcttgaggccagggattcaagagcagcctcccaatacagtgagaccctgtccctacaaaaaaatgagaaaattagccaggtgtggtgaggtgtgcctgtagtcccagctacttaggaagctgaggcaggagtattgtttgagcttaggagtttgaggatgcagtgagacatgatcacactgcactctagcctgggtggcagagtgagaccctatctcaaaaacaacaatgaaaccgaaaaaggaccatgatttctggtttgatgagcaaaaggaactctgatcgggacctgagaacaaaccagttctcccagattcaaggaaatatccactattaactacagtacataatttgattcattaggcaactgacattaatttcttccagaaaacaatattggtggggtggggaaatattttaaaagccactaaaatgcttatttgacttttaccacctgtcctaaatttaaccaaggaaaatctgtatagactcctccttgacatttaaatttacctaataggccattcaaggtttggcaactgaattttttccaactacctccctcccatgagtatacatatatattggttatgatctgtatgttttcccattgggtggaaggctttcttttagataagctactgttttagctatggccaaacttttctttgaaaaaaattattcctctttggggaactccccttgagcttcatagtaaccagggaacccactttactggccacatggacttcttattatgcttaccatcttataggacttatattgttcttaccatccccaatcttctgacctggtagaataaacaaatggaaccataaagactcagttggcaaaatgtatggaaaacttgcacctcccttagtttaaagttcttctcttggtattattactgagaaccactgcttttagagcccacaaattttcatcttttgaaataatcactggtcatcctatgcatttaatgcccactgcctttgaccctcaattgttaaaaggagagatactataatactgtaagggaattattacagtagtagacaaatattatattttggtagaaaaatctttccacagtgtgctcctggaggacaaagacctaaagcaccaagacctaaagctacaacctggtgattctgtctatcttgaaaagacacctatatgaagactctctccaacctcattggaaggtcccataccaagaccttctcaccaatccctgtatcaccaaactcaaaggcattgactcattgatccacatctctcattttaaaagggcttctacttctgcctggaccggtaccccagcaggcaatttaaagtttatctgttatctgaagcagacaacaattgaaataaactgctattcacaagacgtccagaccaggccaatatacccttttccttttactattggtctcttcttatgtgcttttattttcctggaaaaataaggctctaatttgcattttctaatctatttccaaaatgagaaacataaccgatttattggatttggtaccaaaaaaacttcaatctccatgatgcaagtgaacccctggtctaactcataatggatttttttttttttttttgagatggagtcttgctctgttgcccaggctggagtgccgtggtgtgaccttggctcactgcaacctctgcctcctgggttcaagcgattctcctgccttggcttcctgagtagctgggattacaggcgcaccaccaggcccagctaatttttgtatttttagtagagacggggtttcactgtgttggtcaggctgttctcaaactcccgaccttgtgatctgcccaccttggtctcccaaagtgctgggattacaggtgtgaccagcggtgcccagccctcagaacagattttactgatattccccatgtaactgttctaattatacatctagtcctttttacaaggtcaagcttttagactcacatattcagatttcctgtttcaccctaacattacctaagatctacaaaaaaggccttgaagttagattaagattatgcaaacaacatgctgatagaattcaagagaaaagaaatttgacagcttataaaaatatttatgaccttcctcctctaattgttgatgacttccaacagtgcaataattcaataatagaaccctggataattactgttgacacctccctacaagtaactgttaatgcacaaggtactccatctacgtggaattacctgttgtgacacatcgagatacattttcatctgtgggggagcctacagtcagctttattcatgggcaacatcatgtctcaataaatggaaaataaagcaccaatgtggtctgggatatttctacattcaatttaaacttgcaaaatctgaacattggttgacatctactaacttgcaccatcatatcaaaaaagacactctacctagaggcataaactcagcaggatgggcctcagttgttagatccttcttcctctggattggggttagtaccttagaaataatggttagaaatttatccctaactattggagctccagctgactccacagccaaagccatggcagctcaccaaacttccttagattttcttgccaaagtggttttcgataacaggattgctctagattgcttattagctgaacaaggtggtattcgtgcaattgcttacactagctgcacatggaagtagaaaacacaattatgaaagataacggaacatgccacctggctccagaaagttccacccaatgcatttggacttttcaatctgtttagtgacttaccttcaaaataagattcatggtttagagctatttttcaaactgaattcatgatactattgctgcttattcttgacattatgatagttaagttacattattgttgcctgtctaatctttgcaaagcctgctttcccaacaggaaaatgttagtccagtgcttccagatgattgctaatgcctgtgtaactgataagatggaatccaatgctgaatctcaggtagacctatcctgtaagggtctttccttccggcccctttgttgtccaaatgtgacttgggcctctaatgttgactcctattgactcctattttccctctagtgtggggtcagaacaactaggacaaagcacatcccggcattgagggagatcaagcctaacttcaaggatagttgaccagtgatgctttcagggaaagatcttagtcaaaaaagggaaatgtgggcgcgggggctcacgtctgtaatctcagcactttggggaggctgaggcgggtgcatcatttgaggtcaggagttcgagaccagcctggccaacatgatgaaaccccgtctctactaaaaatacaaaaattagcctgaagtggttgcacatgcctgtaatcccagctactcgggaggctgaggcacaagaattgctggaggctggaaggcagaggttgcagtgtgccgagatggcgccactgccctccagagtggccaacagggcaagactccgtctcaaaaaaaaaaaaaaaggtgggggggtggcagggagcagaatgtgaaagttgattatctaaatggagtcatacctgtcatacccaactaaaatttacagtgcagggtgggggggcatagagaaaaaacaaaaatgaaaacaaaactcaggtctcaaaagcctgctccagaaactgtccagtaagcccaattcaacgaaacagctgctacagttttaagactagttttacaaggaaacagccaccatgactttaaaactagttttacctagaaattgtggccactgaccaatcagagctcaccagctcctgcaaaaaacatgttgcaagcaccaaagagctttctttcataacaacccacatactctttctcctttcccaataaaaccttcaccatttttttgttctaccacatatcagagaccaccctggtctacgcatgtgtaccagattgcaaccctatttctttattccaaaataaaccctcttttgcttggagattcatctctctatatatttgttattgatagaagataaaaagctaataagagactgtgtgaacatacacacaaatgaataaaagttggtgaactacctaaaataaatgagatcaagcctgtgtatttttgtctttagcttccggttgggaagaatttcttcctttctatagctgtgagaccatcaaccaaaattcagaacaaactccaataagttgcaaaacactgatcaaaatcaaatgctcactgcagcctcaaaatcctgggctcaagctatcctcccacctcagccactgagtagctaggactacaggcgcatgacaccacgcccagctaattttgttgctgttgttgttgtagagagaggatcccactatgttgcccagcgtggtctcaaactcctggcttcaagtgatcctcttgcctcagcctcccaaagtactgggaatacaggcatgagcgaccatacctggcctaaatgctctctctctctctctatatatatatatatatatactaacctgtaaatttaaaatttcacctaatgagccagcttaaactggaaattttgttttctaataacatttgttttttctgattgaactgatgttttccaacagtagcaaaagctgatgtatagcatttagaagctaaatgtaactaccatgtaatgtagtagtaaatgttactatgtaatagttacatagtaactaatagtatgtattagtagtacacagtactaatactgctgatactactgctagtactatgtaactggtagttacatagtagttacattttgctactaaatgtaactgaatagcatttagctactaaatttatatatttaaatccatgtttacttacatttagctactaaatgctattcagttagtagtgaaatgtaaatatgtgtttaagtatatgaattatatctttaacagtcatgcctattctttagccctacatttgccctttgtattcttacatattttaagatgaatatcagatgtagttctaggtaaatgggaagctcatgatgcacgaagacagaaatggagaaattgagaagatttatgaagctaggtagtattataacatttatcggacactcgctatctaacagactgtgttctaagtcctttgtaggtgttacctcccataattttccctgatattattgctgtttgttctcattttagtgttttggaaactgatgcatgtggatattaagtaaatgccgaagatcacacgaactgttttagaacaaagattcaaacttaggaaatctgattctaatgttcacgtagttaatcactgtattagagtttctgcagtgtacggaagtgttagttttactgaggatgtattgagtttgtctagtagatgtttggtcatttgaaatggaatatcttaaagattgtgaaggtatgaaattggcagtgagacagaagtgaaagtcactgatggcagacaggtaaatacatgaataattcagtagctcaattcattccaatgtattttcctttagcacctgctttgtgccaggtgctggtgtaactacccagtgagttctccttgctcgctggctagacagagtcagtttataagataggggaactgcaatagaaaaagagtttaattcacacagagccagctgtacaagagactggagttttgttattactccccaaacgcttggaggttaggggtttttcggagacagtgtggagggcaaggggggtatggtagggggcatggcatactaattggctgggttggagatgacaccatagggaattgaagctgtcctcttgggctgagtcagttcctaggtggaggacgacaggactcgttggcaggtccaggtggggccatctggttgtcagaaatgcaaaggcctaaaaagatacctcaaaaggccagtcttaggttctataatagtgatgttatcttcaagagtaattggggaagttgcaaatcttatgacctccgaaaaaatggctggtaattatttataattcaggcccctttcatcctaactttgtggactttcactcattttataaaaatagtttagtttttgggaggggctattatcatttaaactataaactaggccaggcacggtggctcacgcctgtaatcccagcactttgggaggcccaggcaggtggatcacctgagatcaggagttcaagaccagcctggccaacatggctaaaccctgtctctactaaaaaatacaaaaaattagctgggtgtggtggtgggcacctgtaatcccagctactcaggatgctgaggcaggagaatcacttgaatctgggaggtggaggttgcagtgagccaagattgtgccactgcactccagcctgggcaacagagcaagactccatctcaaaacaaaaacaaaaaacaaacaaacaaaagtatactctaaatttctcccaaagttagcttggctcatgtcccagaatgagcaaagacagccaacctgtgaggctagagtcaagatggactcagccatgtcagatttttctcactgtcataattttctcagttataatcttttgcaaaggtggttttactggcctaagagatatggatgaattcagggtgaacaggacatttgaggtctctggtctcacagagcttacattctagtgggaggagatataataaataagcaaatcagtaacatttcagtgctataaaaaaaatcaaggtaatagtgtcttcggatgtgtttatggaggctgctggctgttgactaccttagatagtttatctgatagaatgaggaaaagaagtctttcttcttcttcttttctttcttttttttttgagacagagtcttgctcttgttgcccaggctagagtgcagtggtgccatctcagctcactgcaacctccgcctcccaggttcaagcaattctcctgcctcagcctcctgagtagctgggattacaggcgcctaccaccacgcctggctaatttttttgtatttttagtagagacggggtttcaccatgttggtcaggctggtcttgaactcctggcctcaggtgatctgcctgcctcagcctcccaaagtgctgggattacaggcgtaagtcaccatggctggctgaggaaaagtctttctgatgagattgccagaggcgtttaaacctgggcaactccattttgagtaggggctaggtaaaataaggctgagacctactgggctacatttccagatggttaggcattctaagtcacagtatgagacaggaggtcagcacaagatacaggtcataaagaccttgctgataaaacagattgcagcaaagaagctggctaaaacccaccaaaaccaagatggccatgagagtgacctctggttttgctcactgttacactcccacagtagcatgacagtttacaaatgccatggcatgtcaggaagttaccctgtatggtctaaaagggaaggcatggataatccacaccttgtttagcatatcatcaagaaataatcagagccctcgggggtgctctgtctgtggaatagccattgttttattcctttacattcttaataaacttgttttcactttatggactcgccctgaattctgtcttgcgtgagatccaagaacattctcttggggtctggatgcagacccctttccggtatagagagaacattttaggtgatgtcatatgttgaggagctagctgtgagaagataaggaggtgggagtgaggaacattgagaagaagaaacgaaaagtgggcggctctgagaacgtagctgtaccccagacagaaaagtactataccattattatattgtactttgcttctgtgtcagctttctctatcatccagtgagctgtacaaattatctcaaaatctttaacacctattatatagtagacattcagtaaatttatttaacaaagggatggatttagtaatcatttcattaagatttcatgtaccagatacctcagagatacaaaaatgaccaggtgaagggctgtgccctcagtgaactcaaagttgtgggaagcagagttgtgaacaattactgattactaatacaaggtggtcaatgctattggtgctactacagcattggaaggatgatatctcactgtatttgaaagatatgaggaaactgcatagaagtggcaaagttagaggtgagtgttgaaatgtacctaaattagttgaggggtgttaaagaaaaaattattcaatgatcttattaaggcatggacaggcagagtgcgttcaagaccattgcaatagatataggaattactgcaacagggtcttgtagttgggggagggattgggttcaactccgaatatagcataagcaagtagaaatttatagcaaagagcaggctgagggtcagtggatgaaaaattactaagaggaaatatcagaggtaaagagaattctggttaaactcatctcaaaggattcttgctgaagacagccagggtaatcagacttcacctgggggtgaaaagcgaaagcgaaggatgaggaccccagtcagatatctaggatgggggattcttaccaaactgacatagcacggttctttgctaaaactggattttacaagaaagtacacagacagacctaggacatggctggttttcaaaaaccccaagaagtttaggagtagagacaataagttaaaaccaggagtatatgcagaaagagtagtaggccaggaagcgtattcaggaagtgtctgtggatcacattgagggactaagtggctaagttggctggacttcctggttcaatagggacttccctaaggggactttcccctaagccaaaatgagtcatagctgcaagctaagggattgaaacttcaaccaatcaaaggggactttcccctaagccaaagtgagtcccagctgcaaattaagggattgaaacttcagccaatcatatagagagtttaagctctagctgcagcctgatgtttttaaccaatcaggcccaccaacctaagagaggagaccacccctcatattgtgttatgcccaatttctgcctccaaagaaagaagaatttaaaacaaaaaggcagaaatgaaatccacaggcagacagcccagcactgtgctctgggcctggtagttacagattgacccctgacctaaccgatatgttatctatagattccagacattgtatggaaaagcattgtgaaaatccctgtcctattctgttctgttccgattaccagtgcatgcagctcccagtcacatacccactacttgctcaatcgatcacgacccactcacgcagaccctcttagagttgtatgcccttaaaagggacaggaattgctcactccgggagctcggttttcgaagatgtgagtccgccaatgctcccagctgaataaagccctttccttccataactcggtgtctgagcggttcttgtctgtggctcgtccggctacaaacccacaagtggatagaaaataacctaatcctatgggacagaaaaaggaaaaggggaggagtcataaggggatataaacataagatacccaaaccagaaatggcaacccttccaggttcccttccaccacgtggaagctttactttcgctttccctttacttttgctttggctttaataaatcttgccaccgcacagtctttgggtccacgcatttctctagtgaagctgtaacacttgccactgtggtccacggcttcattccttgaagcctgtgagaccatgaacccttcgatcgagaaaaacctttgatcggaagaagacttctcgtctcaacattaaaggacaaagaagccaactctaaggcatgccattagctttaataatctgagtgtaataaataataatgatcataacggattaaaacatcagatctgtaaaaaatgcatgcattcataatgatatcaaacaaacaaaaactttgtggttaactctggagtttggtagggcaccaactcatgtctctgaaatttcataattaaaaagaacaaatccagcatttacccagtctttcctctatgagattatcctggttatctcaggataaccaatgagttggtatgaaaagattccttttatagaagaacctctggtaataatagagaattattgaaaggattagaaattcactgctctaggataaaagacttaagagacataccaaaatgcaacatgaggactttttttggatcttgactggaacaaaccaactataaaagataatttggactcaaacaggaaaattggaattatttatagtactaaggaattattgttaattttgttagatatgataacggtagttaaatttttaaaatctatgtcagtttgagatgcagactaatttaagggtaaaataatattatgtctaggatttctttaaaaaagaggggaaggaaactgaaacttgattggcaaaatgttgctaaatgttgattctgagggatgggttacttgagggtttgttattaaaagtagaatcacttttgcttatgtttaaaattttccattataaatagttttcaaaagcagagccagtgcctaccccacatcatcttctgttatttaatgcccaggactcagaaagggtcagcagtctcagatcaacagttactgatgtcctaacccatcctaaacactgatgctaatgagtgtggggcaaagttcacagcgtgctaaggagcaacatttaggaacctgactggattccgcagctctcgggacaagccccctggaaaagggctggggggaggggcggggaggcacccaattattctagaaggttctgagatctcccagggatttccgagaggctacgaggtgtaactggcaaatcaatgacttaagagtagctttctcccagcctccccgctggctctggagtatagagggaagccagccttttcctcccccatcctgcccctcccctctcttctcatcttcccctccactctcctcctgaccctggcctggccactcctgctttcacttctctccactcctcttcggccccgccccgcggcctcctccctcctccttgccccgccccctatccctgcgcgccggcggccgttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacggtaaggaccgccgcagaccttcctccgcgtccgtcgcctcctaggccaggtgggctcccagatggtgggacctggccaggggcatggcgaacgaaacacgaccctctggactgacctcttgcccacggttgtccttggtcgggtgggggcagctccgagccctccaggtggccgcactcaggttggggtcgggggttcgggtacatcgaaaggcgcgggtgcgctccgcttcggggggcgattttcctgaaacctgttccgggcgttttggtacccagaaagtgtgcaacgatttgtacactcggagattcactcaacgttcctgcataaaatgccctacaaaaatgatcttttctctccaactctctgggcaaatccaagttgggcgaaaagaagtgccagtttatcccatgcttgtttttaggttttttgttgttgttgttgtttgttttttttaacttctgcgtcaaagcattgcttatagactgggtccgctggctcctcttgggccaataaaaccccagtttattttaacggcttggttgtccattttatgttttctctctctccacgctccttgagttccttaagttcctgttctacacatttttgtagccttctgagcacctattctagtgctgatacatatactaggcgcttcaataaataaatgtttattgaatttgccgtggcaagaactgtaaccagctataagcatgattttttccaattttgccctctgcaatcccaggtttttcacctgaaccttgcattgctttcagcaatgtggtgttgcctctgggaatcccagtctcctttgtgtgggaatctagggtacacattcctagatagaggctgtgtaatgattgctgacatattctggccagtgtttttctgtatttactcttggttttgtgaaataaatcaagttagctcctgtaaacacatcaccatgtttttttttcacgggtaatttgagaaggaggacaaacatctccccaaagtatttattaagctggttgtttctttgatgccgaagtgtctcttttgcagaggaattgctaaatgtttccatgtcccttgctaagaacagaaattcactcagagtagatcaaataaaagtttggattgttataaaacaatctcgccgctagtcatggacaggaagcgaagtatagccagggcggatgagaacctggatggggaaaatcagaactaagatgctgtgctctcctgctttctttctttgaccttatgacctttcaccttgttagggttgccacatttagcaaataaaaatacaagaggcaccgttaagcttgaatttcagataatgaataatattttagtataaatttttgtcctgtgcaatattttggaacacatttatactaaaaaattattcattgtgtatctgaatttaaatttaactgggcatcctgtattttatctggcaactctagccttctttctatgtataatcaagccccaagtaatgatatttcggtcaacagtggactacatgtataaggatggtcccataagattataatgaagttgaaaaactccaattacttcgtgacattgtagctgtcataacattgtagcccaatgcatcactttttctgtgtttagatatacaaataccattgtgttacaactgtctacagtattcagtacaataacatgctgtatgggtttgtagcctaggagcaataggctatactatatagcctaggtgtggagtaggctataccagctaggtttatgttaagtaccctctgatatttacacaacgataagctcacctcataacccgtttctaagaacgtatccccatcattaagcaacacatctctatgcttgcttccttccatctgacagaaagcctcttgtgtatggatttctcttactatgatagggactagggtggcgtgcttcttgactaattagccctaaagctcaccaccaattgtatagcgtctttgtgtattgtagctgaaaatttaagttagaaatttaagattggttgttggctggccaatgaattgactggccttgggccaggtttccaccttgacagaactgtggtggtgcaaagatgaacacctttccaggttcttttacccttccttatgaagccctatgtgattagttccctagttacttctctggcctcttatctactctctttcccctccttcattctgcctcatttgtcctggtttctttgctattcttcagacgtatcaggcatgttcccatcctagggactttgctgttcttcagatgtatcaggcatgctcccatcctagaatgttcttcagatatctaactagctaactccctcaccttcaagtctccttacatgccaccttctcaagggcctgccccgaccaccctagttaaaattgcaacccaatcttccttacccgatttcttcttttttaaaaataacaaccctcaaattctaatgtgtaatttgctagtttattatgtttgttgtttgttgtctctctctcatgaagtcaaagatttttgtcgttttgttgatgtattctaagcacctagatagagtagccagtcaataaacatgtgttgaatgaaggagcaaaaagagcctgagcctcttgcagcttttcagccttggtgggaatatccaatgtctgcattcagtaaatcgtatttgttgggttactaatgaattattaggttttaggaattgacacacattatccaaattcaaaagagacttgtttctaaatcacaattcccaaattattaatttctatggagaaatatgtgttaccatgttatctagactagctggtcagggtatttgcctccccagagacaagtctacttgggaaatcaagtgtatccaaaggctgcttgttaatttaatggcaaatcagttgattttaaagggtggtacagtatagtcaatcatgaatattcttcatcactttaaagatatacctgataaacagatacttataatagcagggcaatattttgttgaactttgtaaaaataacagttccatcatcagcaaacttacaaacttaaggggtgaattctgaagatagctgattttttttttaaccgtgttcaccaattctgagatatcatgtggtttgcatctttctagtgcaccaaatatgggagatggtataaatgtattgcttctttcacttgcaaattggcatagtgcgtatatacaaggtctttcccttgaagaattttttgggttacccaggctcaaaaggagttttgttcataggagagaagaaagtgtgttcagggtgtagtacttgaaaacatgctagactttctttatgaattccacttccgtaagctgacttggaatactcagaaaagaaaaacatcttgacaactgttgctggtagaagtggtagagtaacagggccacatgcacaacagagcatgagctgctgcagagtcagacaatatttaaacttttaaatttgttttccaattaagagattacattactttgccattattctcagcctaggggtagatatgttctatctgttatgctacttgattgtttattttgcagatccattgtttattgtgtcaagtgagaaagaccatacacaggcaaatatccaagctaccctgattcgcagcagactggtatgtctaattcatcagccaaggctacctgatgaacctgaaccatctagtttgcctgactgcattgatcagattgactaatcaccaaatcttcactggattttaggttccacagaaattaccttgccaagattactggagggcaaagcatcttaatacgtgtggctcattgtgaggattaagtcaccaataatgaacagagaacccataagctaatttatttcaatgggataaatttaataatatatgcccatgttaaaagaattcaagtagtataaaagcatatacagtgtgaagtaaattctagccctatcccctaccccctccacataaacagccattgtcatcagtttcttgggcatgtatttaaagatattttacgcatacagcaataacccctcttcttatgctgtatacattgttttgtatgtttttaaaaagagtttacaatgtaattaaaatgctttagaaaagctgatggtataattttgtcctttgcctcccttctctaacattagagaaaagttcccaggtttaaaaccatgttcagtaacctgatccattatccaagatattctctatattggagcaagtcagatcctgtcccaccatttatcagtcgggaatggaagggacataaggagaaacacagagaagccctccggcagctcaccacgtaagtgtcgggtggctccagggcctaaaataaatgcattaaaagcatttctttaaattcatttaccatgtgtggttttaaaatgttcagttgtggtgttatacctaggccaaattttctttctaaacctcttttgaccaaacaaacctgattatatattgtatatatgagatatatatatatatataattttgtcatatatataatgacaacttgccaccaaaggtagggatgattgagtttgttgttgcttggatccaacttagcaactgaaagtgctctgttctgctagtatctaaaatattttttgggaacttggggccaaagcaccttcaagaataagtcgaattctttattcttttaattacttacaagttcacatttagtaaattaaaaattataaagccttttaacctggacatagaaaaagtgtcttttggccaggcacagtggctcacgcctgtaatcccagcactttgggaggccgaggcaggcggatcatgaggtcaggagattgagaccatcctggctaacacggtgaaaccccgtctctactaaaaatacaaaaagttagccgggtgtggtggcaggtgcctgtagtcccagctacttgggaggctgaggcaggagaatggcatgaacccaggaggtggagattgcaccactgcactccagcctgggtgacagagcgagactctgtctcaaaaaaaaaaaaaaaaaaaattgtcttttaatattttgctattcttgtgtgcttttaattaaaattgggcatttttgtatgtgggatttcataaatccactcttttctcagctcttgctctgtctgactaggttctggtctcctggctcaggggaagaatcatatatactctaagttgtatggcagtcaaatgcaggttatggaagactttactctcagtatgagatactctgtgtaggtcctactctatacacatagaaatattaaatagaaattatatgtggaaatattttagacttgaataatgttttcttgcttcattttagaactgacgcttcttttcagatgcctaaagaagtttatgaagatcctgaagttactggaaagaatcgctataaatactttgaaaggtagaacataattactaatgaatatttgagccctaatattattagagaacctctttatgataataataatagttatcatttttcagtgcatacaacgtgccagactctattttaagtgctttacatgcatatgatctaatcgttaaaacaggaatgtaggctaagatatatatgatccctgttttaccagtaatgaagctgagaccgagagatgataaatagattgctcaaggtcatataagctagcaaggggtagatctggggttccaactaagcctgcctgactttagagatactgattgcaactaagaatatgtatttgaaaatatttgaaatgaagtcatcaaatgaacgacacacagttggagataccatgaagtcatagtgaaggggaaacttgtgttcaaagggataacatttgttctctttgtatgaatcttgcctaaaccaacaaggccaaaaggttcattttatttcatttgtgatttatgcttatgtaataaccatatactcaaatcaaattaaaattagatggggatttccttatatatcctactggagttagaaaaaatagtcttgataccacatctgtataagcttccttgagaaagtaaatttctaatccacattattatttatgagcaacctccttatggaaattttgtgatactgacttttccagagaaatgttaaattcttaactgttaactatacaattctgtacagttaactgtacaattcttaacttttagggggaggcttcatattaaatcactgtgaattccagaatgtctcaggaacttgagaagttgttgggaactaatggccagctgaagcccaagtacagggcttaaagtgtggcttcttcaagtgtgacttgtttcccatctgaagagaaaatactggagtgtttattaagaatgcacattcattggctctaccctatatgtactgaatctcatgggccagacctgggaatctgcattttagacaagaacctccccaccctgcagtgattttttatgtccagaagtttgagtaacactgatatatgggatatttaagctcactgatttttaagggacaaatattagagctggaagagagcttagagtgcattcattgcaaaagtcccacacatttatgttttctttttcctcccaggccttttctcccattttttcagcagatgccattcaatgttgtttatgccgtatccaagtaagtaaccattatttgaaaactctttttcagtttatttattgtttgcttccatattttttcttagaagatagttcactaaatcactatttttcaaattgtggatcacaaaacattagaagggtatgaaatcttctagtgtgtcatgagcagcattttaaaacatgaaacagaatagaaaataaccaaagcatcaagtatatggagggtaagttggtttttgtttataacttttgtttcagaaaaatatatgcatatgtttatatgtatatgatggattatgatataaaatgtatttcttactgttagttgtccatttgtgctgctataacaaattaacagattgggtgatataaataaaataaatttatttcttgaagttctgaaggctgggcagtccaagaagcaaggcagtccaatgggcagtcagtgtcggtgagggccttcttgctgtgtcttcacatggcagaagaagcaaatgctgtgtcctcacgtggaggaaggtggaaggccaaaaaggacctatgctagttctctgtaatccttttataaggcactaatccattgatgagggtggagtcctcgtgacttaatcacttcccctaaaagccttacctcttaataccacgacaatggggactaagtttaaacatgaattttggagaagacacagacacatattcaaattgtagcagttgtagtttaaaaaagttgaaaagtgctttaaatatcttcttttgcttctctgaaacacttatttgatgacagttcttcaacatttcattaaataaacaaatcagtcatgtaatattttttgaatgctagaattttataacttaataaccatctaatctacacagataatgtggtatacaaagataaataaaacatggtttctgccccacaacggagtgaaccaaggtaagagggaggtaagggacaagggctgaatctgagacaaatgtgtatttcttgtctctagtttcaggacaagacagcagactggtagagtattcctttaaaaatctaatttttgctacactctttcctctgttaatataatttaatatttctgtaagagaaaaaagtctaaggtattcatgaaattatcaggaatagaaaccttttttaaggtctcatatttctgaatacaaatttattcaggactaggttttcaagggtgcatttaaagaatatagttattcctaataatatatatcatcatatgaacaggacatgtgttattaaatgtctgtaatcctcaagataaatgctagttatgactctacttcacccttgacatttttttaagactgtgtggatggctttggctctttatagagatggagtacagattccctgctctccctagacagagcaacttcttggggtaccagtttatccagaaatagctgtagacttatattctatgaaatgttttgtatgagcaaaaggggagctatgagctatgtagatccctaaagagccttctggtaattctttaaaatcaggctcactgaattacctgctttggaggtcataactgcctcagtctaaaagttgttaactaattctagggagttcagaggcctgcagtgatgaacaccatgacctccccaactcctccctaaataaccgtgacacaagggataaagattccatccaagagttaaaccatgacatttgacattgtagctactctctatctgtcttagaactttttaaagaatgaatcagtattcctgagtgaggtcaattctggaattccagtatgtttgagtttctgagcagtgagtataatgccaccttgtgttatcagggatggaattgtcttgggaccagctggccttctccagccacacccttttcatggctagctgttggagtctttcctttggattctacataagcaccttttcaaagagaataaaaagttaatacttttaaaacattcaatgaagttcatagtagaacaggatttgctaggtttgtgaagcccctctctgtacagctctgttggggctgggagagaaaatctagaagactgtaggtatggcagacagtgcatgctcctggtgcctgggcagtggtggaggaggaaagggcctggatagaacacatagagcagccctggctgccataagagtactaaagccagagcaggtgagcctgagggcaggagccaggacacagcaggggtcaggccagcatggagcagatgtgggacctttctgagtttgggtcctgtttgaggttggggaggaggtgggaaagggatcattgctctttgttactcatattttactctcccctaaagccaacagaaatggggaaaaaataggttggagaaattaagaagttagttaagaaaccatgtattaagttactgaaagagttcaaagtagctttcctcttttacattctattccctgacccacctggaaagatacgaagccagaaaccttcatcagaggagttcattaggccttattataaactaa

SEQ ID NO: 596 - DNA, 59554 bp, Homo sapiens
ttggggacccataagctgttagaggtgaaagagacttcagcaatcattccatagaaatgaagctccaggcggggctgtgacctctccccgctcacacggcctgtgagggtggacgctgagcccaggaaatgtaggtctcctgtgcctcagtccttcaggggccaatttaaatgagaagggaagttggatggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttcctctgaaccccagcagctgccagcacagcgtctaggagtagtggctgtggacataattaggagtttcttgagcagcctagttaacagccccacagagggcatgatcatataagaacgtcactcatgtcattatcatttaattctatccgaaaagagttaaaatcaacattctggagttaagtgaacagcttgttaaatgaataacatagacataaaatccagtgggtccaacaagcagtgattactatagttaataataataatatcatcttgatgaacaagaacaggaaagagaatacagataagactatcgccatattcacgtcttttgggatcttgctatgtgctctgcatcatgcagtgggctttccttctcaccagcactgtgcaagtaggatattattattattccctttataacataatccacgtgttttacaagtggaaaagaaagacaagacaaacctgctggtaaatattttgaacccaattctccatttccccactagatggcacttttatacctctctttgttccattttaaactcacagcagatgggcagagcgcacttaatttatggtaagtttaaacaaatcctatgtatatataatatctgggaactttaaatcaaataaacggcttccattcaaatatgctttccttttcaaatataacacttgtaaatatctggtccccggacagcaggttcgcctgtccaccagatgctccaggacggcgctgggcccttgctcctgcgctgaccgcccagcccgagccccggggccaggtccacggtgcccacgcgcgctgtgttctgctggggtccggcttagggctgcttcggccctcggcggcttcctctgcgctgttgctgccctccccacacccctacccctgctcactcagctccttcacctcttccctgatgaactggggaacagtatccccaaccttgatcccgcaatgtattgttaaggctgtgttgtatttttaaaacaaacaaacataaacatttgaatgctgaaggcttagtgataataaaaatagtctacccacccccccacatcacatcacaacacacacacgacacatgcacatataaaacacacattcacacacgaaacacacataaaacacattcacacacatgaaacacacaaaacacacacaaaaaacatgcacacaacacataaaatacacacaaaacacacatgaaacaagcacacagcacacaaaatacacacatgaaacgcacatacatatgaaacacgcaaacacacacatgaactacacacataaaacacacagagatacatgaaacacgcacgcaacgcacaaaatacataaaacacagatgcacacacacatacacatggaacacgcacacaaaacacacacatgaaatacacacagaacacacacatgaaagacacaggaaacacacacacacacacggaaggcacacacacatcgggaagcggcgatggtcacgctcactccaagaccccagctccccgcggaggcctcccgggccggtgttcgctgccagccaaacctaagcccgctcctcgcggggcccgcggggcacccccaggttctgtgcagctgaagcttgtaccattttgtgactgtgacacaggaagcctcctagggacaaacttcggtcagcatttgaatcagccctgactcggtgacagtgtctcataaacgggtcagctggttagggacttggaaagagagcggggaaacgggtgagcagaaagcctggggaacggagcccagcggcgccaagtcgccccggcgtccacctgcgcccaccagagagcgccgggcccccgcgagcggaacctcgaaccgcagcctccggagggctgggcccggcctgaagcttacacgcactcccttctcagtcccacttttgccctgtcttcaccttggagcccccgagtttccaaaagatactggaatccagtctcagcctgagcaccctatagcaaagttaggagtcagccccactaactggaggtaagtggatcatgtgggaggcccaggtgtgcagagcccctgaaaagttacagcgtctccacctgggcgtggagatctgggccaccccagccccgctgggcatcgcaggaatgggcttccagtggctcctcagtgtggccattacaccatcaaacgaaaaccacctcccatggaacatatctatataaaaaacaacaaaacagaccccttcagaaagtgagctcagatgactcccctctgctaagaggtgcctcctgggcaggtatttctgtgggtgccacatacttttggggaaaatgagcccttagcaactcatatttttattcacaaataagccattaaactgtttattgaaggaagagggtatggtctctattagaaaatacagaacaaacatttacaaaaaagtattattttggaatgaatttcagttcaagagctcccttttaaagtcaccctaagcataccggttgctacacaggcaggattcaaaaatgcaaatatcaaaaatactcaaaactctcagaaacaaaccagtgaaattcattgtcctactcattatccaatttatccaacagtaatcattacgattgatttccaggcctgtaactgcctattttcatggcctgtagagaggggagtatagggtgcaggcaggagtgtctgaaggcatggaagtctctgcctgggcattaacaaaatgagtggaaaaagcagacaattgcatctgcgggcattgatatctcttatctgcacgttagacttagttttatgagtaactaaattgagttgagactcttaactgatgttcagattcactgccagcactccccacacataccaggaaacaccctgtgttccagtgggcagacccatgcaagcccacccccaaagcctgggggtgcagagaggccgaggaaagaggctgacaaatccagactctcagaaaggagcgttgaatagggacttatcccacagctgccctccagaaagcttgcttgctttttctttctttcttttctttctttctttctttctttctttctttctttctttctttctttctttctttctttctttctttctttctttctttctttctttcatctttctttctttctttcttcctatctttcttttctttcttttttgatatggagtctcgctctgtcaccaggctagactgcagtgacgcgatctcagctcactgcaacctccgcctcccgggttcaagtgatttgcaccagcctcccgagtagctgaggctataggcgcccaccaccacacccaggtaattcttgtatttttagtagagacggggtttcaccatgttgaccaggatggtctcaatcttttgacctcgtgatccacctacctcggcctcccaaagtgctaggactacaggcatgagccaccgcacctggcccagaaaacgttctttctatagcaagcttttataagactgatgcaccagaccctcttgcaaaactgctgaccagtggggaggttgaataagcatctttataggggtcatctatgccccaggcactgtttgtttataggggtcgtctatgccccaggcattgtttgtttgaaggggttgtctatgtcacaggcattgtttctgaggaactaattggtgagcaggggtccgacagtcacttcaagatggccttactcttgccgtgcactgatctcgccactcagaaaatgctcaaaggccactttttggtgcacacaggaaaggtctcttctattcagctgaatcaaaacatttgaaattggctgtgtttgttttcagatctgttcaggtcaatttaacaattattgtaaagaagtaacttacttataattacataagccccaacctgaaagaattcccaataaccaaaactggaataacttgagtgacagaatgaataatctagcattggattacatcttaaagtaaaaaataaatatccatgagttcatactgatacaaaatgattgaatgaacaaaataatgagagagaagagagaaatccgctgtacaggattccgggtaagttacaccatttctcctctctcaaggatgtggagcttaaccctctatcccttgcttagggagtagagcatggataggagtgaaaaggtaatttacagaggagaaacaggctagttgatgaggtaacatcatcagtggtaagtcatcttgatagtgtgcactgtttaacaagcagatttattgatacataattcatatatacccaaacttccatttaaaatgacgattcggtgatttttagtatattctcagagtagtgtgatcattaatctaattttctatcatcttcatcactcccccaaagaaacctcatacctatgtgtagatttgcctcttctgaacattttacataaatgcaatcatacaacatggggtgttttgtgacctgtttctttcactttcaccttgttttcaaggaggaaccatgttctaaagcctgtacttcattcctttttattgccatataataaaaaggaattgcccttgtataattatacacattttatttacccattcatcgatggaaatgtgggttttctcactttttggccatcatgaataatgctgctataaatattcatgtatgagtttttgtgtagacacgtttatctttctgttgagtgtgtagtacccaggagcagaatttctgggtcatatgggaacactatgtttcatattttgaagaatgatgtttttgaaagcagctacaccattttacattcccaccagcaatgtctgaagcctccaatgtcaccacatcctggctaacatcgatgattccgtctttttgattctaagcccaccttagtgggtgtgaagtggtatcttattgtggttttgatttgcatttccccaaggattaatgatgttgagaacatctttatgtgtttatcagccattagtacatcttctttggagaaatatttatttacttattttctccatttttaattggggtattttctttttattacaaagttgtgagttctttacatattctggatactagtccttgttagatacatgatttgcaaatattttatgccatactatgggttatcttttcactttcttgatggtattttgtgaaatacagaagtatttatttttgatgatgtccagtatatcttattttttcttttgttgattataatcttgaagttgtgtctaaggaaccactgcctaatccaagggcacaaagatttagtcctgtgatttcatctaggagttttatagatttagcagttacatctagctgcatgacccactttgagttaatttttgtgagtgatgtgatacatgggagtccaaatccatcttttccatgtgaattccagttgtcccagcactggaacccttgtcaaaactcaattgaccataaatatgagggtttgtatctggactgtcaatgttatttcattgctctatatgcctgtcatcatgccagctccacacaatgttgactgctggagatttgcactaaagtttgaaactgggcaacatgagtcctccaaatgaattattctttttttaaatattattttggctattttgagtcccttgcatttctacatgaatttttggatcagctaggctacttctgcaataaaagacagctgagattttgataaagatccatttgtggagagtagccatcttaaaaatattaagtctcctgatccatgaatgtagaatatctttccatttatttagatttttaatttgtttcatatctttagcatataaattttgtacttcttttgttaaatgcatgcctagacattttatttttatgctattaaaatgcattttgtccttaactttcattttcgtattatttattgatagtgtatataaataaaattatttttgtatattgaccttgtatgctgcctcatgctgaagtggtttgttagctgtagtggtttttctgtggattccttaggatttgtttatatatatgatcatgtcatctgaaaatggagatcgttttaactgttccctttttctttttcttttataatagccctggctataacatctagtgtgatgttgaatagaagtggctagagtaggcattattgtctcgttcttgatattagggagaaagcattagtttcactccagtaaatatgatgttagttgtggatttttcgtagatgcttctaaccaagacgtgaaagtttcctcctatgtccagtttgctaaaattttaatcaagttgaggaagtttcctcgtatgtatagtttgttaagcatttttatcatgaaaaggttttagattttgtagattactttcttccatctattgagatgatggccatgatttgtgctgtattctgtgaataggatgcattacactgataagctcttggatgttaaaccgaccttccatcaccgtaatacattccacttggtcacagtgtctgatcttttaatatgtgatgcaattaaggttgctaataatttgtcaaggatttttttaggctataagggttatcactgtgtgattttttttcttgctatgtctttggttttagtgttagggtgacactagctttacagcatgagtggggaagtgtgctcttctgttgtatgttttggaagagtttctgaagaatcagtattcattctttgaatgttttgtagaattcacagtgaacccctctgggcctgggattttctctgttgaagtcttaaaattcacaattcaagcatatccatttcttcttcagtcagtgtcagtagtttgggtttttctgggaatgtgtccatttcatctgagtaatttgtggcatgcacaattcatagtattccactataatgttttataattgttcatagtattccattataatcttttttatttccataaggtcaatgctgatgtcctctcttccattctggattttattaatttgattgttctctctctctttttcctggtaagtgtcactaaaggtttgtcgattttattaatcttttcaaagaattcacatgtttttattgatttttctatttactctttcctttatggctactgtaatctcgtttcccttttaatgaacttttttgactatgcaacgaccagttccggtgggtatatgacaggggagccctgtcacagcgctacccaggacccagttccggtgggtatgacaggggaggcctgccacagtgttgtccagggctttgcagatggtttggaatttccctatcagtgcacttgaacacctttatggaggtctgtcctgtggcataattcagattccagagccacagtagaagaggtttcaccagatttgtattcacgttgctgaatctcagtccacccatctctagctggaaatagactacaaagtccctttgtgatactaacagtgtataggcacttacacttttgaaattaggcaatgtgagttctccaacttaattctctttttccatataattttggctattcttattcttattttacagaggagaagactgaggcacatagaggttaaaaattagaggagaagcgagtaagaagtaggctagaaaatcaaatccatagcatctgctcctgaatctacacctttccccaccacctgaggaatcagctaataatggcttccgaactaaatctggcctgctgtctttgtaaataaagttttattggaacacagccataaccattcattgacacatcacatatggtgcttttgctctataacaacagagttgagtaatcgaaggggcgatcctgtggttcacaaagcctaaaatatttactacctggtgctttcccagaaaagtgtgctgatcccagcactgcgctgtactgactgccattataatcatacatgcctcaaggccattttgaaaacaaataatgcaactgattatgcctagaagagtgtctagcacacacatagacacatgtacacatagacacatacacatgtatacacacacttgtgtgtatatataatatatattaatattatatatataatatatatatgtgtgtgtgggtgtgtgtgtatcaaggtcctttttctgacagtctgcctatcagtaattaattgtatcctaaattatttctctattttggttttagagattaggtcatacccgctagtctgctttcctttctcattttgggtctcatttgagccccattcagctgttctccatcactaacatacaagaaatgtctgccgaggttgtgaaggatgaggtcatgattcacactcgaaggagaagaaaggaaaggctgatttccggagtgagactctggtttttggcagagccagtgacctgagcagaatgaaatgacactgtgaattttcattccaacaaagaagaaagaaatccaattgaaaactagctttgactagattttgctgcaaaatagaagatgatattgagctaaataattcaaattcttattcagaacatagagaatgggggggcattcactctctaccgtcaagagcctgctaaggcgatttcagctgctccacgctccccttgcttccagcctcccacgtggccaggctggaaaactgccaccacctccacatcctacccagatctcacctgctagagcacgggcggcagggatccgctccccagcacatcagttttggtccatcagaaacagaacattagagaagactctcaatattgctcatgttagaataaagccagcttcttttctattaaaaaaatgcttgtccaactcgcgtgaggtttgtcagcgacgcagaggaggggcttttgttgttgcaggggtcatacttttccatttgtttttcctcgtggaattttctccagctctcccatttaacactgcgtgccccgccccagcctggccccatgcaatgctttggtgctccagggttgccggtggtcctgcagggtctgcagtcacacaggtctctctcctggaggcagagtccctgtgggtctcagccatgttcttggtcaaatgcagaagtgaaaacaaagcatttcaatatttattgaattaccctatttgctagcctgcattttcattttcaatttatttttacacatatttgatacctatcatgggttgggtacagagctaggttccaagaggaaaacagtaaggaaaaagcattcctgttcctgataagtagtaatctctattaagaaagttcaatgaggacagaaagaaatatcacaaataattgtagtgcaagcagaatcatgtcgttcccaactctgcccacggaagggtcgctgggcttctcaagggcctctggccaggatgtgggatgttactggaatagacgtgcaccattctttgattcattcattcactcactccccacttcacttgcttcttatgccccgcccagccaagttaaatctccttctgtctctcaaaagtgtcaaactgcttcaatctctggggcacagcatttgtcattgcttctgcctgccccttaataaccatatccacctgcttgtgtcttttaactgagttatcagtcacctcctccatgaagctgttgcaagctttctcaggatgacgcccctcttgctgcattgttgcctggtctgtgcctctgtgtagaacttgccacattgcattatggccagaggcttgtgtgtgtccccactaaccctgagctcattgttctacctactccctgcacttaacacagtgtttggctccctataaatgctgaataaaggttgctgattattgcatacaagaatgtattcaaaaatctgcagcatcagatattaatgcaaccaaaacaataagatcttggctattttgcagagtccatagctctgagagccagggggaaaacaacatacattgaattcctgtgtattctatttgttttatgtattgaggcaggtgtttacatgttccagagaatagtgggggtataaaattagacataccctcagccagcctgtaggaagctaactatcagctaggcgattccgtaagatgaaaccacctcttgggcaaatgtatatggcctttgatttagaggcttctagaaattcatttggcactccatagactagacattagcaccaactctcaacattttatcttatctcagacaatattgctttaattactgctagagcggcattgtccagtagaactttctgcagttatggaaatattatttaattgtgctgtccagcgtcactagcctcatgtggcagttgaacacttgtaaagcgactactgcaaccaaggaactgaatttgctttaatgaaatttaaatttaaatggcctcccgtgtctagcggctatcgaatgaatggcctcccgtgtctagcggctatcgtgttgcacggcacagctctagaggcttgggcatattataccatcctatctatgtacactaaacttcgtgactgtggatgcttgtgatgtaataagctgggccctgcaagttaaaattatttttgacatggaggtagcgtgtgatgaagtgcattgatggtagctagggctgcattcaaacttgtagaggcactgaaaccctcatggtgctcctttggccactccctgcctctatgctgtatggaattaaatagattttttaaattttacacacatacacacacacccccccacacacacacgtttaacaacagcctacaaagaataacaaaatccaataaagttttagtttttcctgtgttttagctttttcctcttcaatgcatttttaaattatcaaatataaaattctttaagaggcgaagtgttccagctttgctagtgctcaaatcacctgtgcctgccaggctagactggcactctggcactgatactgctcaaggctgagcagagagctgtggagtgaggttcaccagaccgggaaagacttcatctcaaaatgcctctggggccaggggtggcgcgaggaaagaggttatagaaagccaaggttctgattaaaatggaagtggtttctagagaggctaatacaaacatccatttgtcatctctcaaacccacaaaactccaaggaaccatagctgttctctcaagtggatttcttgtttgccaaaactgtttttggacaaactttacatggaagcctgccatagaaatgagaggaaggcaggctgctggggagggctggaaggaagattcagcttcatgcatttacctggaaacagaggccctctgaggagcccctgagcacttaggaaataaatttaaaaccagtgaaattcactacttgtaggaaaacaaattcagaaagttccctgagtcagctatggcagggcttggctaagaatgaggtacttgtggcttcagtgttaagtggacctcctgctgcagccaagccttcagtactgcagtgttccagccctgagactggcctggacagtgtctagccggggcctgaggagcccaccccgataggtcagtgtgcaatgctgggggcaaagaaaaaagagctcagtggcagtcacagcccaacataaagcacagcttcaattcttcgtgaaatgtgacagggatgagggcaccttgctccaacaaagtcagcctattgagggtagggaagagagggagggttcagagaaagaggggagatgagaggagaaagaaacacttcattacataatttaactatgttctgtgcaaatatccaaaatatgagttaaaatatttaaatctgttgtagccaaatctgagttattcgtcattgctatagaagatcatttgcacaaagcttatgtttcatggattccagtttaaggttagtccaatcctgtccccgacctcatcccagcccactgtatcagttatagtaaaaatcattttaaactttatccccaggtcaggttccccagacacactgtaagatggagacttgcatgcaggagatttggggacatgcagtggggaccaatgcctgcaaagacgttgtgctgcaagagagggacttggggacagagccccagccaaccccaaagggtgctctggaactggagggatccaagcgagttgtcccaaactaaaacaggaggtctaccctattgcccactcctggcaagggaaggaggcgtgaccttggcttgatcctatctgctgaggaccattcctgaagagaaacccagctagaagccattgtcagtcactacagcaggagagattctggcctcagttctgagggggatctgggcagtgccacacagtatccaccatttttggcttcacgtgcccctgtgggtatctgactctggccacagaaccagctgctcacaatggaagaaatgttgagatacttggttccacacgctctcctaacagaaacccaggctcagaacaatgaagcgagttgtccttgggcgtgccaatggttgtcagacgttcttttccatcggaatcacctggagggtttgttactactgggctccatccctggagtttctgactgggtagatttgggatggagaattggtgtctccaacaatttcccaggcgcctctgctgctgctggttcaggagccacactctgagaagcacggggaagcaggtgaatgttgggaagacattctgcaagacaggagtggcagaggcgacattctcatggtggagaaaaggaacaaagcacccgagacagtcctggaactgcttcctgccagtccacttgctgtagaatcagccgctgtgggaggagtgaaggcatggggccaggagcttgacgttctgaattggaatcttccctctaccatttactgactgggtcatcttgggcaacttactgacccattccgtgacgcagttcccataagacggggatggtgatgacaatagttacctaagtcactgtgagggttaaacgagtcgtagaaagtacattttgaggagtgcttggcatattttaggtgtacaaagtatcctattagagataaatcagctgctcttttcgttcttctgatggattgctaatgaacaaatatccatgaaggaagaaaaccagttgtagctttttgtggttcaggagaagggctgccatgtctctttggacaaaatttgtatctactctaaggcatacaaaacagtgccaagagaatacattttaaaatgagctttaaaaaaaaaaaaaacttaggccaggcgcggtggctcatgcttgtaatcccagcactttgggaggctgtggagggcggatcgcctgaggtcgggagttcgagaccaggctggcgaacatggtgaaaccccgtctctactaaaaatacaaaaagtagccacgtgtggtggtaggcacctgtaatcctagctactctggagactgaggcaggagaatcccttgaacccaggaggcagaggttgtagtgagctgagattgcgcgcctgcactccagcctgggcgacaacagcgaaactccatctcaaaaaaaaaaaaaaaaatttagccattttaataggtctacagtggtatctcattctttttaaatgtgtatttccataagaacatatgatgttgagcatctttcttatgctcatttgctggtgaagtgtctgttcagacctttgcccatttttttaatggggttgtttgtcctcttattatttagttttatacattctttatatatattggattcaagccctttatcagatatgtgttctgcaaaattttcttccagtctttggcttgtcttttcatcctccagcagtgtctttttgtttccaattctaatttgattttattttttaacttctattttagtttcaggggtacaggtgcaggtttgttatacaggtaaattgcatgttgcagggcttgggtgtacagattatttaatcacccaggtaataagcatggtgtgccgtaggtagatttttgatcctccccctcctcccgccccccagtctcaagtagaccctggtgtctaatgttcccttctttgtgtccctgtgtactcaatgtttagctcccacttataagtgagaacatgcagtatttggttttctgttcctgcgttagtttgcttaggataactgcctccagcttcatccatgttgctgcaaaggacacgattttattctttttatggttgaatactattccatggtgtatatgtgccatattttcttatccagtctaccatggatgggcatctaggttgatgccatgtctttgctattgtgaatagtgctgcaatgaacacatgcatgcatgtgtctttatggtagaatgattgtgtattcctttgggtatatactcaggaatgggatcgctgagtcgaatggtagttctgttttaagttttttgagaaattgctaaacttctttccacagtggctgaactaatttacattcccaccagctgtatataagcgttccattttctctgcaacctcaccagcatctcttaacagtgtcttgtgcaaagtaggagtttttaattttaatgcagtctaacttacttttttttgtttcatgaattgtatttttgatgttgtatccaaaaattcatcaccaaaatcaaggtcatataaattattgtatgttttcttctggaagttttacaggtttgcattttaaaattaggcctatgattcactttgagttaatctttgtgaaagacataaattctatgtctaggttcaaagccatgacccagttattaccctgtgaggacaggtttggctggcatggctctgaggagccagaagacagcatgaggacctgtggcaagaaggaaagaagaaggaaaggacaccggaaactgtagctggaaaagacacaaggcaaactttgtaattggtctcaggctagttctgtaagagtggaaacacattcactaatttttaataatgtaaaatttggaccattgaaagattcaaataatggctgtaggtggtcaaaaaggaggattctgacacttttgttagtgaaacattatccgtatcttagttgttgcatcaaaggacacattgaattgggctgtggcaactgcagcctccctgtgtgcccaacccccactccacatgcgtggtcggctccagaggtgggattgttccaccgtggaaggtgctcacatgtggggagcccagcacctctcttggcctgcctttgtgttctcctaactctatcagtaatagaataaataaagtagaactttaaccttcagactgctaaaacaaatgtcttctgtgttgccgtttctttaaatgtgaataaaagcctccttccttccttccttctctccttccttccttctctccttccttccttcctcctcctcctcctctttctcctcctcctcctccttcttcttcctcttctccttcttccccttcttcttcttcctcttctccttcctcttcttcttcttccttcttcttttcaattttatatggcactaagacaatatcccaggaccaccctattcgtaaactgccatcacccaaacttgtcataggattgctttagatctggattgtgatgatgtaatagcaatgtttatcatgcttttattgtgagcctggtgctatactaatttatataaagatgatctcgtttaaaattcccaataacatgcaagagctgatggtattttccctgttttatgaatgaagaagccgagactctgacgggttaggtggcttgtctgtggacactccctcaataaggagcagggctggctggcaggcttgctctgaccccatcagcaatactctccactcccctgccacggtgcctgctgccggagggatctccaatcactcagctgaattttaattttatcttatggatgaagagtcacgtttgagagtatactgaatggaatttttccacgtaccgttggtactatgaattgtaactacgtaagattgaattgagagctggcaggggagctttgcttggcaaaaatcagaagtggggaaattaaggctgggctggagctaatgtacagtagcggagacttctaaggctcattcatatttcagcctcctctccatctgggcttctcccaccccccgattctgctgcaattaggcagagccatgctactatttctgatgaatgaattgtggtgaaaaataatgtagcttaaatatagcttaataggcaggaacatgtatttacttgttggtataaaatgtgtagaaataggccaggtacggtagcttatgccgtaatcccagcactttgggaggccgacacgggcggatcagcagaggtcgcgagttcaagaccatcctgaccaacgtggagaaaccccatctctactaaaaatacataattagccgggcatggtggcgtgcgcctgtaatcccagctactcgggaggctgaagcaggagaatcacttggacccagaaggcggaggttgcggtgacctgagatgacaccattgcactccagcctgggcaacaagagtgaaactccatctaaaaaaaataaaaaggtcaagaaatgttgcctcctgttgtgacgatcacttggattcatggggagaaatctcacttgggattacccgggggtcagtcaactacaaagttgcccagacacacagaggactttgcacaagtgagaagtcaactcgttgggttttaaccacagacttgagcgttggtggttcacatggcatcgcctggccttcccggcaaatgggctctccgttagcccgttacctccagtttaggtgataggcacactgacatgctccctccccgccatgctcacaatttatcttctataattttgaaataattcagacttctttggaaaagcttctgtcatttacttcagtctggaggttgaggatcctccgtagagtaggcgccagccacaattttaaaaggtgttcctatgatctcttatttcctgcagacggaaggagtcgggtttctgtgctgtgcctactgcagggaaggggctggaaatggattctctcatcggagttattgaggacctggaccgaggctcaggtgtttctgggcactttagaaatgattcttacttttcttccgtattgaaaatcaaaaaaaaggaagatgttatttcagctcatacactgtaacaaaattggtgatatttagctttcctatttaccccattttttgaggcagcagaaattcaagctataacaccatcaacacctgtgaagggatttattggtagagatggagtttcttatccactgaatccttgtgttgagtggagtgggctcacattcaacagctactatagcagtcatagaggtcacatttcactaaatcataagtattctagtaaaacaaatgcaaggctgggtgcagtggctcacgcctgtaatcccagtatttcagcaggctgaagcaggagcatcgctggagcccagttaaagaccagcctgagcaacatagtgagaccttgtctctacaaaagcaaaaaattagctgggtgtggtggcactcacctgtagtctcagctactcaggaagctgaggcaagagagctgcttgagcccaggaggtcaaggctacagagagttatcatcatcgcaccactgcactccagcttgggcaacagagcaagatgctgtttcaaaaataaatagatgcatatatttgcatatgtacatgcatctaagttatagatgcatctattttatatatatgaatctattaatatagatgcacctattatatataaaaatagatgcatctattatatatatataatatatatgcatctattatacatatataatatatgcatctaattatatattatatattatataaattatataaaatatattaaaatatatattataaattatataaatatatattattatatataatagatgcatatatattttctatatatatatgcaaatatatattttggagctatttgggtaaaagtaaaattatagaattgattctcaatgaaataccatttatttaataaaatggtagaattagtcacttttctgtattacatcattatttttacattttgaagcattttactttcagcaattatttgcacagttggaatctttagaggaaacgcagagaatttgggatgccatgctggcctgaaatttcaatcccaagagcactgactgccagataatcagtgtgaatgagaaggaagacttcgactcaaatctaggactagattaaaattatagatagatagatagatagatagatagatagatagatagaattagcttagtttatatgcataatatgtatatataattatacattaaatgtggttattacatattagaataaagttaaattgtacacttgtgcatatacacacgtacacatatatatacacatatgtgccataacaagcattttgaatatataggtaggtgaaaagaaagaaatgagtaagagaaggagggagagagggaaggaaggaaaattagattgtactagaatgaaatacatgaaaatattaacaatgattattgatgaatggtgaaattatatggactattttaaaaaaataccacatgatattttatttaataacaatacattgttctaataatcactaaagtaaaacaacaatgaatgcaaattaaaagaagcaatatgaatggtactaagttcatacctaagcatactttaaagaaaaagttattttattttttaaaataagctttattatttcattgagaaatgcctctcatttgcaaaagtgtactctgaacttctgatttgcagtccagcacataaagagcttgacatcatccctcacatcctaacaacaggaacaaagctgaatgaactggacaccagcaacttttcttggatccgtcagagaattgaggtcactggacatgccaccgccttaaaattggagaggcagacagacaaacccagagaattatagcttaattcaaacacagcccaggagcagcaatcgccactggagccagtactggggtaggaaaacttagactgcaattgacaaatttctgaaggctcttgtagataagcttgagcattaaaaatgccagaagggggcctggtctggggtgggggcacacttttgtgagttttacctccagaagccctgcggttctcatggtgagaaaagagaaaaatcccctcttgcttcccaaagggagccgttttgagatatgcccagagcattttgtgctccttaacaagacccatcttctaaatttacaaggaaaggcaaaagatccagatgactagacacaatattaaaggaaaagaaccaagttgaagagttgacattacctaacttcaagacttatcgtaaagctatagtaatcaagacaatgtggtattggtgaaagaatagaaaaatcgaccagcggaacagagtagacagcccacacccgcacagatcccatcaagcaatctttgaaatagacaaatcgagcagcggaacggagtagacagcccacacccgcacagatcccatcaagcaatctttgaaaagggcgcaaagacgtttcagtggagaatggatagtcttttcaggaaatggctctggaatatctgcatgcgtaagaaatgaattagacagagtttacatatttcttacatatttcacaaataattaactgaagatgaatcaaaagtctaaatgtaaaatgtaaaactatgaaactcctagaagataataggagaaaatccaggtggcctcgggtatgacgatgactgttcagatacaacaccaaaagtatggtccatgaaagaaaaaaattatgtcagacttcattaaaatcaaaaacttctgctctgcaaaaaactctgttaagagaatgaacagacatgccacagacatgcaaaaacacacacttgataaaggatttgaatccaaaatacactaagaactctattttttttttttttttgagacagagtctccctctgtcgcccaggctggagtgcggtggtgcgatctcagctcactacaacctccacctccccagttcaagtgattctcctgcctcagcctcctgagtagctgggactacaggcatgtgccaccatgctgggctaatttttttgtatttttagtagagacgggatttcactgtgttagccaggatggtctcgatcccctgacctcgtgatcctcccgccttggcctcccaaagtgctgggattacaaacaaagaacttttaaaactcaacaataagaaaacaaacaacccaattacaaaatgagccaaagatctgaacagatacctcatccaagatatacaggtagcaaataagcatatggaaagatgctcaacatcatgttattagagaaatgcaaactaaagcaacaataagacaccactacatacctattagaatggctaaaatccaaaatgctgacaccaccaaatgctagagaggatgtgaagcaacaggagctctcattcattgttttgtccttacaaaactaaataaactcttactatataacatggaaaatgcatgtcttggtatttatccgaaagggctgaaaaactatgcacacataaaagcctgaatgtagattgtatatgctttactcataattgccaaaactagaaagcacctaagatgttatccaataggagaataaataaacaaactgtaggacaaggttgtaatggaatattatttagcaataaaaagaaacaagctatcaagccattaaaagacatgggggaatcttaaaggcatattgctaagagaaagaagccaatctaagcccggcactcacacctgtaatcccagcactttcggaggcagaggtgggcggatcacaaggtcaggagatagagaccatcctggctaacatggtgaaaccccgtctctactaaaaatacaaaaattagctgggcatggtggcatgcacctgtaatcccaggtacccaggaggctgaggcaggggaaacacttgaacctgggaggcagagattgcagtgagtcgagatcgcaccattgcactccagcctgggtgacagagtgagactctgtctcaaaaaaaaaaaaaaaaaaaaaaaagaaaaagaaaaaaaaagagaaagaagccaatctgaaaaggctgcatgctgcgtcaatccaactatgacattctggaaaaaccaaaagtatggaaatagtaaaaaaaaaatcagtggccaggcgcggtggctcatgcctgtaatcccagcactttgggaggctgaggcaggcagatcacctgaggtcgggagttcgagactagcctgaccaacacggagaaaccctgtctctactaaaaatacaaaaaaatcagctggatgtggtgatgcatgcctgtaatcacagctactcgggaggctgaggcaggagaatcgcttgaactcaggaggcagaggttgtggtgagctgagatcgtgctattgcactccagcctgggcaacaagagtgaaactccgtctaaaaaaaaaaaaatcagtgattgtctaggatttgtgaggtggaaggaaaggatggatgggtggaacacgaggtttttagggctgtgaaattattcagcatgatgctataatgacggttgtatgtcattatacatttgtcaaaacccataacatctacatgtaaccaagagttagccctaatgtaaactacagattttagctaagaatcatgtaacaatatgttcatcagttttaacaaatgtcctccgctaatgcaagatgttaggagaacctggaagggtaggagaagaatacataagaaccctctgtattttatgcttaatttttctgcaaatctaaaactgctctataaaataaagtctactaatttttaaaagtgtacaccgatttggaaataagtcctactacacaaaacgtgatgggtaagcctgaactccgggtccagactgcttgagtgagctgggacaaatgacgtgtggaaaatagcaggaacagtgcctggccatagggctggtttgaaagggcagatgaaaatctatggggagcagatggccaagtgcctccagatggttataacattagatagagttctcataagataatttctactagtaagaaccactcacaatgggactcggctctcttctgaaatagtttcatgtcgctcaagtatccaagcacagactgatggatgaattcagtattcagtattggttttgaaaagaaacacggcattataaggatgatcaaatagtacgttctgtaatgtgctggaattttgggatcgtctgaaagaaggtgacatgtaaaaccacttaggagattgtaaaagccaaacattcaagacgttgtttgtgaggatcgtcttttttttttactgcacatttcagctcattgtcaaacaaatttctacagagccttggaattatatagtatcagcattggagaaaacatcagtgctcataaaatcagccgcactttacagatgtggagtaagaggtgctcaaagattgagtttccctggtcacaaagctaatcagtgataaagttgagttcaagctgtggctctaaacctcacttcaggactcattttattatatatgctgccactgttattattagtcacagtaacggtttcaaaatcctaaagaccccacatttgcattgaaaccaagataatttggtttttctttccggagtccctcctcaatgctccacggtcatcagtcagcgcctttttgggagaaaatgtttccagctgccactctttgtagaagttgctcccatttgctgttctatgtctacaacgctgcatatcaaaattttacaacacgtgggcgatgacatttacttactaacataatagcaccttcacactaaacaattttcaaatcactattatattacctctttgtaataggcttataaagttgacaggacagaattttattttaatcttcatgttatagatggcaaactggggttcagagaagttgcatgactcacctacattcacagagccaatccgtgtgtgaagtgggttttgacacaagtctcctggcttctttatctggtgcggcctcatttgctgttgctatttggaaataaggtgttacagaagctacttaatatgcttgattcaaagtcatttgtttggctaaagaaataatgtcttaataataattctttaaaagtattttataatatttgatataggcaaaagaacataagtaagctatatgttacctattatgaagcacaataataaaataaacacctgtgaactcatcctctcaaaataccttgaagctacctgtgtgtcttcttcatattattactttgtctttcccccagaggtaatgcttatcattatctcttttaaaaatgtttattttttaaaagctagcccaacattatctgtatctctaacattatgttgtttagctttgtttgtttttaagttacactaaatatttttccaggctgtatgctgtcttcagcaaattgctcttttcattcaatatttgatttttaagatattttattttctgtaacagtttatccatgttctgctaaatcatattccatcatgtgaaatagcacaaaatatttatgcatttgttttgcatcagtggacatttgggttgttgagaacttttttctgttgtgaacaacgataaatggaattttcatgtttgtctcctgtgcacccatgtaagtatttacaactgggtatgaaattggtgggttaaggacgagacaagtattcaaactcatgaaatgctgccatactggtttccaaagctgttgtgacaatttgagttatcagatcttagttttttccagtctactgttgataaaataatacgtcattgagatctcaggacgtatttcctgagaagctaatgagggtaaattactttttgtggttatttgtaatttgggctttcttctctgaaataattcttcatgtcttttgcccattgttttttgttttctttgctaggtagggattttttggtcaaatgtagtgtatgtatgtatcctctcccagtttatggctttccttttcatctcctttctattttcttttcctttttttttttttttttttgagatagagtcttgctctcgtcaccaggctggagcgcagtggcgcgatcttggctcactgcaacctccgcctcccaggttcaagcgattctcctgcctcagcctcccgagtaactgggactacaggcgcccaccaccacgcccagctaatttttgtatctttagtagagacgtggttttgccatgttgcccaggctggtctggaactcctgacctcaggtgatccactaatctcggcctcccaaagtgctgggattacaggcgtgagccactgcacccggcctaaagcattttcatgtactcaaatatttcatatagtgaacagtcttttatggttaatacttttaggtcatatgaaaaatccttcttcactattaagtttataaaattgtttttctaaaacatgtaaagagggttttgttttccatttaagtctttaacccatcaggaatttactttagtgtatggtaatagtagggatccagcttttcctcacatggatgaccaactgtccccacctgatcttttggaaacctgatcttttcctcagttacaggcaatgtcaccactgctgtcttatttcagttttctctatctgtgagggtctatttctcgacttgtgatttcgttcctctgttcagtttgtggatcctactgcccgtgccttaactaacattgctttacagcctgtgttgatatccgccaagaactgctctcagagtctcaacagagtcctgtctattatatgtttgttattccatgttaactttagaatcatatttttgtcatgtttgtcaaaagtggcagaagaaagaaaagaatctatgggggtttgactggaattggattgagtctagcctatactattgattgtactgtcgcaaacttggtaatattgattctttccatccatgaacatattacagaatcttttcatttcttttgtctttatcattatctttcagtatagtttttttttttttttttgttctccatagtggtttcaaacatctctcactaattgtatttctggatgtcttgttttttttaatatgttttacttgtaaagccacccgggcctgctgatttctctgtacaaacaattttgactatagattcaatcattttaatggcaaaaatacttgtcttaatagaatgtctaaagacactaagcggttaaaaatacttttctgcagagaggaattgaattttcttctgctgggagccagggagcacgtctgagctagagccacttcagcgcctttgtggggtccccctcccctgcccacggccctgctgcctctggattgctgctggcatatggccctcagagaaaccaagctttcctgtgaataatacctagtgaatgatattttatgtgaataatacctagtgaatgatacttttctgtgaataatacctagtgattgatagatacttttatgtgaataatacctactgaataatagtttatgtgactaatacttagtacttagggccctgattttaattcaagttattacaataaaaatttattttctttattttgtaattgccccttttgatatttctctgatttccggtgagctcagaaatgcacaaaagaaaaaaaaaacatgttgtatggaggacgtagatgtttttcagggaaaggactctttagaatatccagcctgaacttctgccaaaaataaacatctccagactggctcttaggtaggcacttggcattattcacggctcccaattcctaacaacaacaacaaattttgcaatgctgagtgtgatgaagggtagctgagaagcgttccctttcatttagagataatcacagtcttaaaaaagaaagatctttatttaagataggcagtgattaagccaccccttgcaatgccactgccccccaagttttctacacatctaccactcagaatggcacaatggaaatatctcaatgcaacagcaatactatggaatgcttaccacatgtaggcaccatatacagtcacacgattcctatttatgtatatgcttacttgcgttcactggaaggattgccttgcttatcattattgaattccagtgaggcctgcatgcggcaggtgtgcccagcttggactggccaagctgcagtttgtgatcgtgctcccacctttccaagccgtctgctcacccttattgatgtggacttgaatatctgggcatgactctcaagcatgtttccaagggctcctgtcactcaccactcttgaatgtgagaactgtgcctcgtgcatcactatgtcaaccagctagcctggtacatgtttgctgtaccgaactcttcagagggggctgggagtaaaggatacaacttatcccctttctgcgtaagcttggctatttatgatgtttcaaataaaaaataacatggttctatctactaatttgtagcttggtttacattaacacacacatacattcacacacacacactcagagtccatcaaataagtggaaatatccaaagtttatctgggggagtatcactcataggaaatacatagacgcagcctaatgaacacgcaggcttgtgtttgccctgattttatatttcatgcacgtagaatctggattccattctatctggtttgtgaaaaagttttcaccatttactctttttcaaataacaaacatttcttgtgaacttacaaatgtatactatgctgtaatgttcagcaacacaactaaaagaaagggactaggtaccagccctacaggaactctgattctcctatacgaattagataaacaggctgggcacagtgactcacgcctgtaatctcaacactttgggaggccgaagcagggggatcacaaggtcaggagttcgagaccagcctgaccaacatagtgaaaccccgtctctactaaaatacaaaaattagccaggtgtggtggtgggcacctgtaatccgagatacttgggaggctgaggcaagacaattacttgaacgtggcgggtggaggtttcagtgagccaagactgcaccactgcactccagcctgggcaacagggcaagactctgtctccaaaaacaaaaacaaaaacaaaacaaagaattagataaacagttgcaggagggtaaaaagtgctttgaaatatgtacatacaaagaatcaggacagtaaccaagagtgattacttctgcctcagttaggaaagaattaacaggagtaattacagttgagccagataggagttttccaggaggagcacaacatcaacatgtcatacagagggaacagcatgatgtagtgaaattgcaatgagaaaagcatgagtttacattctggactcatcactctccagtttttggttaacaatcactttcctttgagagaatcatttcttctttgcaaattaggcacaattacttatctcagacatagcacaggattgactgagataaattatgaagtgcttagcacagcacagcactcctaaaagtcagtcaagtggtggtagttatactttgcaaagacaaataagtcatatgcaggaggctgaggcaggaggaccagcctgggcaacatagcaagaccctgtctctacaaaaaataaaaaaagtagcctggcattgagaggtgacagcgtgctggcagtcctcacagccctggctcgctcctggcgcctcctctgcctgggctcccactttggcggcacttgaggagcccttcagcccaccgctgcactgtgggagcccctttctgggctggccaaggccggagcccgctccctcagcttgcggggaggtgtggagggagaggcgcgagcgggaaccggggctgcgtgcggcgcttgcgggccagctggagttccgggtgggcgtgggcttggcggccccacactcggagcagccggccggccctgccggccccgggcaatgaggggcttagcatccaggccagtggctgcggagggtgtactgggtcccccagcagtgccggcccaccggcgctgcgcttgatttctcaccgggccttagctgccttcccgccgggcagggctcgggacctgcagcccgccatgcctgagcctcccacccgcttcacgggctcctgtgcggcccgagcctctccgatgagcgccgccccctgctccacggcgcccagtcccatcgaccacccaagggctgaggagtgcgggcgcacggcgcgggactgggtgaagccagctgggctcctgagtctggtggggacgtggagaacgtttatgtctagctcagggattgtaaatacaccaatcggcaccctgtgtctagctcagggtttgtgaatgcaccagtcaacactctgtatctagctactctggtggggccttggagaacctgtgtgtccacactctgtatctaactaatctggtggggacgtggagaacctttgtatctagcgcagggattgtaaacgcaccaatcagcgccgtcaaaacagaccattcagctctaccaatcagcaggatgtgggtggggccggataagagaataaaagcaggctgcggagccagcagtggcaacccgctggggtccccttccacagtgtggaagctttgttctttcattctttgcaataaatcttgctgctgctcactctttgggtccacgctgcttttatgagctgtaacactcaccgcgaaggtctgcagcttctctcctgagccagtgagaccacgaacccaccagaaggaagaaactccgaacacatccgaatatcagaaggaacagactccagacgcgccaccttaagagctttaacactcaccgcgagggtccgcggcttcattcttgaagtcagtgagaccaagaacccaccaattccggacacagcatggtggctcacgcctgtaatcccagcacttcaagaggctgaggaaacactgcctgagcccaggagatcgaggctgccataagctgcgatcgcatcacagctctccagccggggtgagggaacaagaacctgtctcttaaaaaataaaacataaattagtcctgagcaagaaataaaatgttggttgaaaatttttaaagtattttccaaagtgtccagagtctcattccccattgtctatttcccatctgtatttgatctgactttgaaaaggtctttgaataaattgaagagcttgaagatggtgaagagaaaaatgttttgcccaactttactgttgtttaattaaactttttgttttgagatattggtaagttcacatgtagttttaagaaacaatacagggagatcccaggtactctggtaagttttccccagtggtaacactgggcaaagctacagtagaatagcacaaccaggatactaacatggatgcagtggagacacaacattcccaagaccacaagcatctctcatgtggcccggttatagcctaccccactgtccacctgcccccacccctcccgaaccctgacaaccattaatctagcctgcttttctattattttgtcatttcaagaatgttatgtaaatggaatcatctagcacgggaaccttttgggattggcgtccccctccctcactcgtggttccctgaagattcagccaggttctttaatgtattggtggttcattccttttgattgctggatagtgttctgtgatatggatgtaacacagtttaaccattcacttgctgaaggacaactgggttatttccagtttttgtctcttatgaatcaagttgctataaacatccttgtataggttgctgtataaacagtcttcatctctctgggatcagtgcccaaaacagtaattgctaggtcatatgattgtgtgtgtgtgtgtgtgtgtgtgtgtgtctgtgtttaagaaactgccaaacgtttcaaactgttttccgagtggctgtagcagcttacattcccaccagctctgcgtgagtggtcccaccaaatccttgccagcttttggtgtcctttttttttttttttggtagccattttaataggtatatagcgatgcgaagtgattttactttacacttctctaatgactaacttattgaggatcttttcatatacttatttgccatcagtaaaatgtctgtttgtgtcttttgccaattttctaattggatttttggtttttactgtggggttttcagagttccttttatgttctagatattatttctttgccgtacatgtgttttgcaaatattttctcccactctctaatttgctttttccccgtcttttcaggatcactggcaaagcaagcaaaagttttagttttgatgaagttcagttttcaatgtttcatgtcatgtcctgtgtttttggtatcgtctaactctttgcttagtcctagatcttgaagatttccttaatttattttttctaaaaatttgcacatctacattttacattcaagtctatgattcattaattttgtataatatgtgagaatagatcaaggtacattgtttttgcctacggatatccaattgctccaaaaatcagttgggcatatttatgggggtcttatttttttagttcaccattctgttctgcttatttacacatctatccctttgccaataccacagccttgattactgtagctatataaagtcttgaaattgggtagactgattcttctcactttattcttcattttaaaaactgtttttgttatttctgttttttgctttttcatagaaattttacagtgatcttacctgtatgaataaaaattgctccgggcttttgataggaatcttaacaaacctgcgcatcaatttgtggagaataaatatctttactctgttgagtctttcagtctgtgaacacagaatgtctttccatttatctggatcttgatttcttcatcagcattctgtagttgtcagcacatataaatgttttctagatttacacctaagtatttcatttttttgagtggttgtaaatggtgctttctatcttaatttttggtgtccatgtattcattgccagtgtatggaaatacaaattattctttatcttgttgaattcacttattcacccaaatatcacatcttatagaaaattaactcaaaatgagtcacgaacttatatgtaaaaggtagatgtgtaaatttttagaaaaagaaaattacggaaatcttcagaatttagggctaagcctaaagagttctttgacttgataccaaaagcacagtacatacaaggaaaatggaaaaatcgcaattcaacaaaactaaaacttttgctttgcaaaagatcctgaaaagagaaaaaaaattatggcatggaagaaaatatttgcaaacacatatacaaaaactatgaaggttttttggtaatgttttttgtttttgcttttaaattacttgaaattttctttgtagaaagtcacgtcacctgtaaataagggcaggtttattgcttccttttcaatctgtttgtcttcttttctactttatgtcttattctcctgactggaacttcttgtactgtgttgaggaagagtgatgagagtaggtatgcttgttttgtttctcgtcttgggggaaaattcagcctttcaacattgactacaatatttactgtaggtgttttgtagatgtcctttaatcaagttaaggaagttctgtatatgttctgaaaattttcttttttattttagatatttttatttctcctaatttgttatttatcaggagtgactgaaataaaaaatataattgagccctgtcatcattatcatggaaatggctttaagagaaaactgatcagatgaatactattgcctcccattttcaaccacgaaacagttgccactgataaattgacagtcaggagtctgtcaagaatgctcaagatatgttatataatacaacatgcctgttcacagggggaagcatcctaggaaataacttatgtgtacttctgatttcatcatacaagacaagcacaaacgcaccacccatgcctctgagaacattggaccatgcacccttgaaaaaagctctgcctccttcatcaggagcaatcttcctccagcagtgaagcctgcctgtgtacatgatgtcagctgcaccctgactgcatcatcattccgtggcgaacagcgtcaaatggataggaagtcaacccagcaacggcagtgacggactgcgcgatcatacggctgatgacatgtgagtgttcctggaatctggaagcattctccttgcagtgtcatagacaccgaagcaggcagctcggtagatgataataccctgcacagacctgttagagccttggtacaggcctttaatcccatcagatttgtagatcttaaccaggcggtcaccaaggccttggaattccctttcagctccagctttacccacatcagctgctagatgggtacggtcaaaatcaagagggtatacaaaacataaggatgtggccccaggggcaccacctgatgccagactccctgcaaacttgtgccaaaactggatcctcttgtcacaccccccgggaagatctgcttgtttttatctttgaaggcaaagttgagagcgtgggtagggaagtatctgatgacattggccaggttaccgtgccagagggacaggactcctgctccttgggaatgcggaccatgcagtctacaacgcccgtgtattgcttatctgcggtgatctgcttgctggcactctgcacctgcagcagcagcttgacccctccgtgggtgccaccgccatcttggagatggccgcggtcactccacctgccaggaagtccttggcaaggacacagcggcatctgtcatgttgaaaggaagaggaggcaggcggctgcgggatgggactgggcgggaaccggctttgactctggggctgcagggcggaaattttcattatgaataagtatacaaatattataaactgtttattctgccttgatttgatgtaatgttatttttcttttttagtctatattaatatggtggataattactgattgacttttgaatattgaaccagccttgcatccctggaataaaccctttttgataatagcctataatttgtttcatatacatttttttctttttcttttattttcgagacagaatctcactctgtcgcccaggctggagtgcagtggcgcgatctcagctcagtgcaacctccacctcccgggttcaagcaattctcctgcctcagcctacaaagtagctaggattacaggcccgcaccagcacaccccgctaatttatttttatttttatttttaatagagacagggtttcaccatgttggccgggctggtctcgaacacctgacctcaagtgatctgctcgcctccacctcccgaagtgttgggattacaggcgtgagccacagcacccggcctgttccctatattgttgaattctaattgctaatattttgttaaggatttttgcttgtatacttatgaggaatattcatctgtagttttcttttttctctgtcttcatctggttttggtatcacagtaatactcatttcataaaataaatggaaaagtattccttcttgtcttatttgctgaaaaagattgtgtagaatttttggtaattctcttttaatgtttgatagaattttccagtgcaaccctctgtgcctgggaatttcttttttgtaattttttaaaagtatgaattcaattttcttaatagttgcattttgttttatattgggtgttggggtcgtgtgggtttttttttgtggaattagtccatttttgtctacgttgtcaaatttatgtaaatagagctatttgtaatggccttttattatctttttgatgtctcaagagtctgtagtggtagtacatgtttccttcttaatagtaatattttgcctcccctctctttttgtctttgtctattttgctggaggtttatcggttgtgttggtcttttcaaataaccagttctttgattaatttctccatttttttatgttttcaattttactgatttttctttttattatttgattccttcagcttgctttactaatttgagactttttctctttactaatatattaatattattaggttggcacaaaaatatttgtggtttttgccattgaaagtaatgttaaattttttttttctcagcattcctttagcaatgtcccacaaattttggtctgttgtattttcatttagttctatctatttttaaattttgctataagactttctctttaacccacaaattatttagaagtgtattgtttcgtttccaagtgtttggacagcttcctttatctctctgttttttatttctagtgattgcattgtggtcagagaacatcctctgcataatccaaattatttaaaatttgttgagttttttcttatggccaaagatatggtctatccttgtgtatgctccatggtctcttgggaagaatgtttatactgctgtcattgggtgcagtgttctacacatgtaaattagaccctgttggttggtgatatggttaaattcttttatattcccactgattttctgtctagttgttctcccaactgttgagagaagggaattgaagtctccagctagaattgtggatacttctatttcttctttcagttctgtcagtttttgcatcacacattttacagctttattgtttggtgcattcaaagttagtattgctgtatcttcttgctgaaagacatttataatttatcattataaaatgtccttctttgtctctggtaattttctttgctctgaggtttgtttcatctaatattagtatagccaatccttttttccctttgattaatgtttgtttgatatatctttctccatccttttactttcaacctgcttgtaccatatttgaaatgagtttcttgaagaacacatgtatttgggccatgtttcttaatatatgctaccaatctctatattttaattgttgtatttagatcatttatatttaatgtcatgattgatatgttagggtttaaaactgccagtttatattttgttttccccttgttctgtttttatgttttgttttgtttcgcactctgctttttcatgattttttgtgagtgtttgaacattttttagaattccattttgatttatctattttttttagtgtttctctttgtatagcctatttagtggttgttttaggtattacaatatatacataacattagaatctactgatgtgattatttcatcagtttgagcgaagtataaaaaccttatcttcctttatgtccctgtattcccccaattttttatttttgtttattatttatacttattttttgggatgcagtctcactctgtcacccaggctagtgtgtagtggtgcagtctcggctcactgcaacctctacctcctgggtttaagcaattctcctgcctcagcctcctgagtagccgggactacaggtgcacaccactatgcccggctaatttttgtatttttagtagagatggggttttaccatattagttaggctggtcttaaactcttgacctcatgatccacccaccttggcctcccaaagtgctgggattactggtgtgagccaccgtgcccggcctcccctggttttttaatacagttttaaacattttctctatgtatatttagagccatatcaaagtagttctatatttttttgttgttattgagatggagtctcactctgtctcccaggctggagtgcagtggcacaatcttggctcactgcaacctccccctactgggttcaagtgattgtcctacttcagcctcctgagtagctagggttaaaggcatgtgccaccataccaaactaatttttgtatttttagtagagacagagttatgccatgttggccaggctggtcgtttcaaactcctgacctcaggtgacctgcccaccttggcctcccaaagtgctgggattacaggcgtgagtcaccatgcccagccagttctataatttttgtttcagctgtcaaacataatttaggcaactcaagagtagaaggaaagcctattgtatttccccatatatttgcttccagtgtccttttttcctttctgatgttccatggtctttttttgttgttttgttttggctttttttggcttttccttttgtctaagagaagttcttttagctgttctttaaaaattgatatactagcaacaaattctttttattttaatttacctgagattgtcttgatttcagtttattgctgaaggatattttgattgggtataagattctgggttgacaattctcttcttccagcagttgaaaaatattatgccacttctttctgccttctatggtttctgataagaaacctttttaatgtgataatttccctataagtaatgtgttgtttttctctgactgctttttagatgtctccttttcttcatattttaaaattttaattacagtttgacttggtgtggatttgtttagggttttttcatcttcttgaactgatagctttatgtcttttgcaaaatttagaaagcttttcgccactatttcttcaaatatttttcagctcttccctatttctcctctcttctatgactcaaataacaattatgttagttcttttgttacaggcctctcttggaggctgtttgcattttcttttcagtcactttctccctgttgttcagattgagtaatttctatcatcttatttaccagtttactgatgtattttctctgttccctccattctgctactgggcgcatccactgagcttcatattttggttattgtatttttcagttctaatattctcatttgatgcttctttatatcttcaacttatttgctaagattttataattttgctaaatacctctattttatttcaagtgtgtttgcaattgcttgttgaagtatatttatcatgctgcattaaaatttttgtcagataattttaacatctctgtcaccttggtgttggcatctatagggtctcttttttcatttagtttgagatccccctagtccttcacatgacaagttactttcaattaaaatgtggacatttttgtattatgctatgagcttctggattttgtttaagccttctgtcttaactggcttttcctgacactattccggcagaaaaaaatgtggagggtgctgtctagttactgccaagtggaggtagaagtcccaggttcctcacttggtcttcactggcatctgagaggtggtttcttgtaattctgagtggggctagaagttctagctctatgcctgatctccactgacatcacagtgatctcattacactgggatgatgggtaaagtcctgactttccactagtcttcctctgatgccacccaagtgtgggggttcttaggggagtgaggaatcttatgattgccgagtacgggtggaagtcagtttgcttgcatggtctccattgacactgggaggaagggtggaatgaggtaacactgctgttactgactagttattatgaaagtcttagctccctacttggccttctctgatgccaccctggcattctgttgtaccttggtgcagtttcacaaaggtggaagcctaggtgcccctaagcagcctttgctggcctaggtggggataaggccaatttttttttctgtgatgtctgctttgagttgaggctttagaggctcacctcattttatcaaagtgctttcagtgctttgtcttattgcactttgcagatttttttttttatttttacaaattgaaggtttgtggcagtcctaggttgagcaagtccatcagcactattttccaacagcatgtgctcactttgtgtctttgttacatttgggtaattcttgcagtatttcaaaccctttgattaatattataactgttatgttgatctgttgtcagtgatttttgatgatactattgtaattgtttgggagcaacatgaaccatgcccatataagacagcaaaattaatagataaatgttgtgcatcttctgacatctccactgaccagcccttctcccatctctctcccttttctcaggccttcctatttcctgttaataatcttacagtgacctctaaatgttcaagcgaaagaaagagtcacacatctctcactttaaatcaaaagcaagaaataattaagcttactgaggacggcatgtcaaaagctgacattggcttaacgctaggtcacttgcaccaaacagtcagccaagttgtgaatgcaaaggaaaagttcttgacagaaatgaaagtgctattccagtgaacacatgaatgataaaacagtctggataaaagatcaaaccagccacaacattcccttaagccaaagcctaatccagagaaaggctgtaactctctttgattctgtgaaggctgagagagagctgaggaagctgcagaagaaaaatttgaagttagcagaggttggatcatgaggtttaaggaaagaagtgatctccataacgtaaaagtgcaggtaaagctgcaagtgctgatggtgaagctgcagcaagttatccagaagatctagttaagatacttgattaaggtggccacactaaacaacatatatttagggttgatgaaacagacttctactggaggaagatgccatcaggactttcatagctggagagaagtcaatgactgacttcaaagacatgaacttcaaaggacatgtaactcttgttacaggctaatgtggctggtgactttaagttgaagccaatgctcatttaaccattccaaaaatccttaagaattatgctgactctactctgcttgcgctctagatatggattacagcctgcataacagcacatctttttacagcatggtttactgaatattttaagcccccttttgagaactattgctcagaaaaaacccaagattatttttgtaatatttgcgctctttgacaatgcaatggtcactcaaaagctctggtggagacatacaaaaagattaatgttgttttactgctaacacaacatccattatgcaccctgatgaaggagtaatttcacctttcaagtcttattatttaagaaatctatcttgttaggctgtagctaccatagacagtgattcttctgatagattagggaaaattaaatttaacaatttctgggaaggattcaccattccttttaatgccattaaaagcacttatgattcttggaaggaggtcagaatataaacactaatgaaaatttgaaagaagttgattccaatcttcatgaatgactttgaggggtttaagacttcagtgcaggacgtcactgcagatgtggtagaaatagcaagagaactagagttagaagtgcagcctgaagttctgactgaattgctgcaatctcatgataaatcttgaacgaatgagaacttgcttcttacacatgaacaaagaaagtggtttcttgagatggaagttactcctggtgaagatgctgtgaacattgttgaaatgacaacaaggaatttagaatattgcacaagtttagttggtaaagcaggagcggagtttgcgaggattgactcaattttgagagaatctttactctgggtaaaaagctataaataccaactcatgctacagagaaatctttcatgaaaagaagagctaatcagtgaggcaaacttcatcgctgttttatttttgaaaattgccacagtcaccccaatctttagcaactatcacactgatcagccagcagccatcaacattgaggcaagaccctccaccagcaaaaagattacgactcactgaggactcagatgatcattggcatttttcagcaataaaatgtttttaaaattatggcctgtacatagttttttttagacataatgctattgcacacttaatagactatggtattgtgtaaacataacttttaaatacactagaaacaaagaaatgtatgtgactgtctttattgtgatacttgctttcgtgtggttgtctagaactgaacccacaacatctccgaggtacgcatgtatcatttcaaaatatcgtcttgttggtttgttcgtttttctttggctagaagagcatttttgtccgagtttttcccccctacgcatgtccagtttgccagcttcttcaataccacagctgaaatacctgaggcaaaaggaaacaccaggagctcaccaccatgtcagttctgtttttgtctggctttatttttatttagtagttgaaaaatgtaatcaatgtctattcctagaaatactctcttcacttggtttcttaaaacacatatgccgctggttttccccctacctcactggctgattctcttcttcattttgtttctttcttttcttccagactcgtaagtactgacatgttcctgtattcagagcttgatcctcttttcttcgtgtttttctccactctaaagctggctgcatattaaaatcatgggaacgtggccgggcgcgatggctcaagcctgtaatcccagcactttgggaggccgaggcgggcggatcacgaggtcaggagatcgagaccatcctggctaacacggtgaaaccccgtctctactaaaaatacaaaaaattagccaggggtggtggcgggcgcctgtagtcccaactactcggagggctgaggcaagagaatggcgtgaacccgggaggcggaggttgcagtgagctgagatcgcgccgctgcactccagcctgggagacagagcgggacaccatctcaaaaaataaaaaataaaaaataaaaaataaaaatcacgggaacgtaagatgcaaacatgtatgtctctaattttaggcggtcctagttaattctcatatgttcccagggctaaaaacaactattagcaacaggtttttctaatttttaaagaaactatttatttctttttctgttttttaaaagcttttatgtttatccagattatatatgaacccactttaaagaattggttctttaagttttgttaattaaagaaaaatatatattctggatagtaactgctctctatgtacatagtttccaagtatttcctcctattctgtaggttctctttactctgttgtttatttcttttgctggacagaagcattttaatttcgtataaccctgtttgtctatttttgctttggttttggttgcttgtgcttttgaggtcttctccaaaataatccatgcccagacccaggttatgaagcatttcccctatttttttcctgagtagttttatagcttctaatctcacatttaattctttaatccattttgagttgacttttgtaaattgtgagagataaggggtctatttcattcttcttcttgtggatatctaataaaaggataaaagatacccttttattaaagatactgctctttccccagtgtgtgttcttggcacctttgtcaaaaatcagttggctgtcaatgtgtgggttcatgtctaggttctctattctgttccattggcctacgtgtgtgtttttatgttaataccatgttgttttggttatgaatgctctgtagtatattttgaagtcaggtagtgtgaagcctccagcgttcttcttttcactcaggattgccttggctattctgggtcttttgtagctccatatgaattttaggattgttttttccatttctgtgaagaaggtcattggcattttgatagggattgcattaaatctattgattgctttgggtaatgtggtcattttaacaatatgaattctttctattcatgaacatggatgtctttccattatacctcttcaatttttttgatcactgttttatagttttccttgtaaagctctttcaccaccttggttaaatttatttctaggtattttattttatgttttgtagttattgtaaatggaactgccttttaacttttctgtcatcttttggaattcctcttattcagatgatatatcttctgctctgaccctttaatttttatatcacttctgtttcttattattattctttctactctatttaatgagactttttttaatcaattttacttttcaagcctattgtacttttatttatgccataatcttaagttctaagagatctttttaatttccacatttcctccttttcatctcattctgctcttgattcatgaatgcaacatcttatcactacaaatatataaataacaacgtatttttagaatagtttattatttagatttactttttttctgcataatttctgttactttttatcccaggtttctttttagctgttaatttgctttgtttggtgtttatctttgctgttaaaggccttcttcagatgtcagtaatcttgggttatctgatcacatatgagtgagaaatgaacaatgtgacttgaagttcttgtcagtgcaattgtatggtgttggaaacatgttttggggatatcctggtgttggaaataatcagatgggttttttcccccttttgtgctagtcatgttccctggagaagattccctgcatattctactggaggtgaaacgtggaagctgagtggcaagaggggctggagggagcactggcattcagggtgcatgtgtgtcctcacttcgccctttagtttttgcctcagtccttaggcctccactgtgccttttgtactttaaggagaaacctttaaggagagacctccccccctcttctttcatgctcccatggagtataagcttcctcttttatagccatggagtgaggaagttgctaagtgatgttaaatggggaatatgagctacatttctagctaaagagctttacaaatccgtctcctccctgtctctactaaaatacaaaaaattagccgggcatgctggcacgcacctgtaatcacagctaattcaggaggctgaggcaggagaatcgcttgaacccaggaggtggagcttgcagtgagctgagatcgtgccactgcactccagcctgggtaacagcgagactgtcaaaaaaaaaaaaaaaatccatttcctgtatgttagcttgcttccttgcttccttttacttttacttcagagatacttggtgccacccatttctgagtctcttggaaattctggggtttaaatgagactagtttttagctttctcctgatagtttagaatttggattccggagtttcctaagtaggattgtctcaggcctacttgtcacctacataaatgtgccatttttctcttctcttactctctccatcctcctggcttcatttttaaaaattacttttactgacatttgatagagtttcagtgttgcaagggagcaaagttagttgcttgagttcaatctgccgtagctgtggaattctacattctaaatcttttctttggtgggacacgggctcggttgaagagtagaaaagagagagaacaggtgatgctgactgagttttgggtttgggggaatgtgagagagtgagactggagaggaagaggagatgctgaaagttacatggagaaagatgggtggatgtttccatgacctccacttaggagtctgcacttccttattagtctctgatatttcagtcctgcttagtgacctttaagattgccctattttttcactggaagttgagtgaggacagaggtagctgccagcaatatccactgtggccccacctaagcttaccgcctgggtcactgtacccacctccatttcatcactagaagagttctgagaacaggacgtgaagacagccttccaggccagaagcaggccaaccaggtttcaccctcacgctcaggtgtgccaagggctttgattcctgctgttcatccctttggaaaaatattgcccaagcctcctgataaccgcctgtgctcctgaataggtatttgtttggagaagggtaggacttcagctaaagcctttaaaatgtgctatttgcttgacttaagataatcaatagacactatctatggctaacttcatattcttatgatgtgggtgtttttttttcctttgtaagtcacctcaaatcctaatggaacaggaggtatattaagtactgaaatgaattaaacataatcgatttcctcagtttagattatttgctgtttttggttcattgattttcttgggactggaattcaaatgactgctaggtaaatcatctttcaccttatattatctattgataagtaatgattaggttggcatatgtcactacaccaagatacatactggaagtaatctgttacttgcaaaatgtgaaagcaagctaatttcaggtcattatttgtattgaaagtccacatttcgtgtccacatttggtgagttaaatacaaattaattaggaacatatggacaaaattcctcttgtaacagggacagacttaaaaatgagaatatatgtgcttgataagagattgagtttagaaaatacataatttaatagtttaaattatttaataaaagccacaatatcactgaatgcacccacatgaattcctataagttaatattgagaatagggatcatatattttactaaatatatgttagtaaaccatgcactgaacatcaaaacttccataagagtaggagaaaagggcaacatcaagtttaacataaacagaatacttgagtaaggtgccatccttcaagccaacatcaatagcactcagagcacaagatgcagaaaggtgggagatgagagagagaagaggctctgcaaactgagttttgagattctggaatcttcaaaagagggagcctagagatagagggaaaagctaaagtttgttagcactgtggagaaagctagagtgcaaggttctgcacccattgcctaggagtttgcattttcttattataatccaaatttggggtctttgatacctctgtcaacaaggatgtgatgtcctgtgaaggtacagagacctgccagaggtgatttacatcgggccagatctgttgctggccctttaaatgaagacggccatcttagtcatctctggctgctataacaaaaataacaccgactgggtggcttaaacaacagacacttatttctcacgattctggattctggaagtctgagatcagggtgccagcatggtcaagttctatgagggccctcttctgggttgcagactgctgacttcctatggtattgtcacatggcagaaagagagccggttagcttgtaagggcactaatcccattcaagaggtctccaccctcatggcctcattacttcccaaagaccccactctaagtaccatcatactggggattaaatttccacatatgaatttgggggagacacattcagtcctaacagccaccttcctgggagggtgagcactaaggccgggtgagagcccagcatgtgaggccgggtgagagcccagcatgggcccaactatgcacccagaactgtcttctcatgggtctctcacccgcttgtgcctgctttgtgtgtctctggcattttattcctgggctctcaatacccatccattctggagagccatttgatgtggtgaattcaccaacttcagcttctatgtaagctcttcaccccgtactggatcagtttggtggattcaaacccaatgaggtcacaaagcttgccaaaagttcgcttttattgcagcaaaatatgtagctattacttgtggcatgcagatcagctacactgggtaggcagaggaattcccagggttctaaaccctattcaggaacacttctgggcactcagcagtaacagacaggacccaccgaaaaggacgggtcatcttgcctaggcagctgcccatgttcagtcctctagagctgctactctgataccaggctatttattactcttataaggtaaaaagaaacagctaaaaccatacacacacacaaacacaatcatgattatatgactcatatacacaggtattcagccatttgagttggctcctccttaaacactcatctttaggctgggcacggtggctcatgcctgtcatcccagcactttgggaggctgtggtgggaggatcacttgaagccaggagctcaagaccagcctgggcaacatggtgagaccccgtctctgcaaaaaaatagaaaactcagctgcgtgtggtggcatgcccctgtagtatgagctacttagggggctgaggtgggagggtcgcttgagcctaggagatcaaggctgcggtgaagtaggattgaaccactgctctctagcctgggcaacagagcaagatcctatctatctccaaaaaaaaaaaaacaataatctttagttgtccctaatttatatctcattatagccccttgattttagcatcactaaactatgagaaagagacacttcctccgccactcccttgtcttatgaatatttcattgcctccccacgataccctcctgattggtgagaacaatttaaacaagcaggcttgcaagctgccaggatgcgaaactcccaaaatccttcccagacaaggtccaggggagagaggctgcctggcacttcagatatttgtgtcattgcattgctcttttaaaataacttcctttgagctggagctccaagacaaagataataataacaaaataactaattttttgattgacaaataaaaattgtatgtatttatggtttctcttctacatataatactattccctacccttctgtgtttttttttgttttgttttgttttttgttttttttttgagatggagtctcgctctgtcacccaggctggagtgcagtggcgcgatcttggctcactgcaacctccgcctcctgggttcatggcattctcctgcctcagcctcctgagtagctgggactacaggcgcccgccaccacgcccagctaattttttgtattattagtagagacagggtttcaccctgttagccgggatggtctcgatctcctgacctcgtgatctgcccgcctcggcctcccaaagtgctgggattacaggcgtgagccactgcgcccggccccttctgtttatgtttgtgaaactcctaagcaccattctaaactcagcacaaatcttaaccacttcggttacaatttcctctgggcacaattatgcactcacttctctgtcttcctgtagcatttcctcattctatagtgcaggatttactggcttatccttacctttttagatatttaacttcccttccagatgatgggacctcatagggaagttactttggtcctccctttacactcagcagcaaacacataaaaggccctttaaaatgttgaatgaataaacatgggacacattgttgatcctttatgtttccccagcatcccacccaaaaacagattcaaagtacaaggaaggtaacagtcagattcctcaaattcaccaaaagaaagtacgtatctagaacagtcaacttaggaaggtgtctggcctgagggtttggttgagtgtttgcagcacattatgtatctccagccctggcttggtagtcagtttggttttttgttttgttttttgtttttgttttttgagacagagtctcggtctgtcgcccgggctggagtgcaatggcgcaatctcggctcactgcaacctccaccttgcaggttcaagtgattctcctgcctcagcctcccgagtagctgggatgacaggcacccaccaccacacccagctaatttttgtttttttggtagagatgggggtttcaccaggttggccaggctggtctcgaactcttgacctcaggtgatccacctgcctcggcctcccaaagtgctgggattacaggcatgagccacctcacctggccgccagtttgtttttttgttttctgttttattcctggaaactggagaaagaaaactggagaagtcgaatgatctaatgtgaatcctgtgtccctaacacttaagacaccttgggcctaagcacacaataaagaataagaaaaataatgaaaatgaaaagtcatattcatttcttcttacccccaatatttaattttttattactataaaatggaatattgttctggttagatgagattttcatacactgtaaccaaatttcttacaagtgtatgtcaattttaagattacagtagtatttaataatattgcattttacccaatgaacaggtaaaataaaggaactttattatagttctcatatgagaactatgactaaccacactgtcctttcggatatttacatctgaagtatactctttgaggggattcaaatattacaaaaccctttgtaatgggttgtattttatacgaaatgtttgttttcttctgagagcagtcaggttgaatttaaaaaggattacagtacaagaaaatgtaactttttttttcttacagaactatcatgaagacttacttaaattgaccttatttgtagtttatcctgatctcgagcaatggtggttttaatactttgctgcgttcaggtcaaaacaggtggaccttaaacagttgactcatgatggcatttgtgctctgatagtaacagctggttgctttgtatttcaaatgaattttacaacccagctaatggctctttgttctcagataggaaaaggtctgtaacccttttctccctccttgggaacacctgaagcaagcttgaccctaagcagacctccttgcaaacatccactgctaaactggggtctttcaggggtttcctgtaccaattactcatcgagaaatgcttttagcaagcaagatattcctggtctgtctggcacagatagtttattgtcaacaaacctgtgatttgttgcagctgcgttgaagaatgaatgttggaaatctcaccagaaagagctctgtgacatggaagatgaacaagctgagagacccccaagctcagtggcagctttgtactatcctatccccaacaccacactctccctcggaagccaaaactcctcctggcagagaagggcactcaggaagccacgtcggatgggctggggaactcctagatatggatgctgcacatgctattactttatcatatataatctactaattatcaataacagtgtgtaacatatacaatccactagttattagtaactgtagtctgttaataataacatcatcgttgtcatcatggctgtgacaatggggcagtctgccctctccctccccatctccacgatcatctatatttatggaacatacatctaaatgcattattattttcattctgaacatcagtatgaggggtatgtattccattgcctccctatctatgtaccaggtgctgggcattgaggggtatacagaccttggttctaccctttatgatctaaaacagctgaaagtattgacataaggatactaaaaactaaatagaggctgggtgtggtggctcacgcctgtaatcccagcactttgggaggccgagacagacggatcacctgaggtcaggagttcaagaccagcctggccaacatggcaaaactccatctctactgaaaatacaaatattagccaggcgtggtggcgggtgcctttagtcccagctactctggaggctgaggcatgagaattgcttgaacccgggagtcggaggcttcagtgagccaagattgtgccactgcactccagcctgggtgacagagtgagattccgtctcaaaaaaaagaaaaaggaaaagaaaaaaaactaaataatttattgacattacagatataatttaattttaactactaagagcacaatcagaacaattctgttttccatatccatttcatgtccctcctggcaccctgaaagattgcatgttccagttatgtggggccatgcacccagtttgtagtcagtggaatgaggacagaaatagcactacactgtagagaaggcaagcctcgcctctgttgaggctattctgagatctcagggtgcccagctctgaagtggagcagggataaatccatggttctggacatgacatgtatttcatgtaagtctgattgacaattaaggattttgtgttcatttgatttaaaagtcacagaaaaatccaaccttcaattgtcttcacacaaaggaatgactctaattgcacatctgactggaaaactgtaaagctgggatatggcactcttgccgctgtgtggacgcgggcaccctggagctggttctccactctgcgattacctggctctcttcggattctactaagcgtggaagaagttacttagagcgaatactttacatttactagtaagatagctgcacaggctgggacttttctgacaacagtaatgattatcattagttattttaatagtttaaatagtgccttggagagtaagaagatctactgttaagggaagaaaaaacacagctgagttgtcttattaatgaattgagctgctcattagctaattttttccacagtctttaatgatctcctggttaatggctgctagaaatacagaagcactttaataagggctctcagtctaaaacatttgcagctgtaacattgactactctgcacataataataactcagccaacttttcctgtgtgcttaccatgtgtcaggcacatgtgggaacagagaatacctttatctgaaaagacaaacagccttaattcatttggctacctaacgggtttctaactcaagttacacataaatttattaaatcgggtcaactgatgtaattagccaactgttaaaaattgtgcagacggagagagccggtggatcccgatggtcatgacttatgagaaggcatacatcacaccttgcctctatggggaagaaaattcatttttcacagagagtgtaagtctccatcctgaggtaatagagaagagagtttgtgggtgtcttgttgttattgttgtttctgtccttaatcttcccaccttgcatttaaaaactcaataaaaaaaaaaacagtgactataagtcaccatgttctttgttatggaagagacaatgtcttacaagcccttaaagttgaagtctctgatgccctccagcagttgactggggatacctggttacttgtcagctcctaaccgggacacagagtaggtcagagaagtcgacccgggagtgttgggtagcagccaagcgtgcagacgcgggaggtcagccagcctgcactgaaatgccgcctttccttgtgagaaactgcgactttgctcaggtgaatacgttttcaacatttcactttcctcatctctgaaaatggagccctagtaacctcctcactggactgctgtaaggactcaattccaacgcgatgatacatacgatgtactggtgtgcaacgggtatccagtggatggcagctatgatttttgtgtttattattaataatgggagtacaacttgggcaggttcatctcggtgatatgaagcttcggtttcctctgcctaagatttgttgaccctcctgccaaccaggacttgaaccttgcccaaatttctgtgtatcttttttaagctttgccaaactccccccacaccccctactcccatccagaggctggatctgccttttacccctgtcaacaataccgttgcccactcccctcttcccacctgccccccctccccagccactggttgtatttctgtcatggacaaaatcatcaaaatgatgctgatgccacttgctttttagaatcagcggacacagtgacttccttccgtatccctgccccacttatcagctgagcacctcggatctcagaaattgcctcagcggggcactaggcttgactgttgtacaatgaagcactgagctgccacagctggggcaccattgtactacgacggtgtgtttcccaggctccctccccagcttctgtctccttcctgttggcttcggtcctggcgtgcctcacatatgagcactttgtgttaggctacgcaaagaaataagaacagcaaccgcatcaaaggaggttacaatttacctttcaacacaatcatcatctactcctaatttccccacttgggcgattagtataaaacttattattttactactttttatgtatcagtagaattctattaataaatgccagtaaagcatacaattcagtaatacaaaccttgttttatcctatcttatgttggctggctggtgtagatcacaccactgaactccagcctgagctcactgtaacctctgccttccgattcaagagattctcatgcctcagcctcacaagtagctgggactacaggcatgcaccactgtacctggttattttttctgcattttctgtagagatggggtcttgctatgttgcccaggctggtctcaaactcctgggctcaagcaatcctcccacctcagcctcccaaattgttgtgattgcaggtgtgagccatcacaccaagtctcacagcgattgttaatcataatttgtaattattaattagataactccagaaatatacatgaacttggtgataatttactctgataatacatcatacaaagataatataaattctgccagaatactctgtggcttcttctgcttcccaaatgtcctacataaaactattaatacttgtaaaagacttcagtgaagaatgaatttcccccagctgagcaagcgtaatttggctatggccagatgaaggagcgttctgaagcaattcttggcatggaagcaaatggaaaggccttatgcataggcaaccaagaaaaaaaaatctaaacaatttaagatgcagtgacttcccaggtgcaggtgcatcagtcacatactccatctaccatcggcatgtcttgcttttgtaacaagagtctctttctataatacgggcagttggtcttgtactcagctgggcattcagcatggctcctgtctcagcaaacggagtcggaggggttagctctggtgtaggatgcctgcctgggtggcaatccctattggacaggtgaaaatagatcattattttaaagtcttgatccggccttagaggttcccctgtgtttcctgttctgctagagctgacagctaggactcctcaagctgtgcacgattgctttctgcactgtgtgtggctggagcctctaggttagcaatgtatctactcactccagaacggtcttttcataaagaaaacctgggctgggcgtggtggctcacgcctgtaatcccagcactttgggaggccgaggcaggtggatcacgaggtcaggagatcgaggtaatcctggccaccatggtgaaaccccgtctttactaaaaatacaaaaattagccaggcatggtgatgggcgcctgtagtcccagctactcgggaggctgaggcaggagaatcaggtgaacccaggaagtggaggctgcagtaagctgagatcgcaccactgcactccagcctgggcaacagagcgagacgccatcacaaaacaaaaacaaaaacaaaacaaaacctgatatgttaaatcactttaaatcaagtttgtccaactgcggcccatgggctgcatctggcccaggacagctttgaatgtggcccaacacaaatttgtaaactttcttaaaagattataagattatttttggcaggttttctttttagctcatcagctatcgttagtgttcgtgtattttatgtgtggcccaagacaattcttcttccaatgtggcccagggaagccaaaagacgggacacccctgctttcaatgcttctcggtgctcttaggataaagacccaggttcttcccatggactctgcacccgatacagcctggcccgcactccctctccagcccctctcctaccgcatgccgctgcccccggccttgtgtcctccagcatggtgacctcctctcagtgtccagggttccctacccccacaaggcctttaccatctcttctagaactccgctctgccttccagttgtgcctccactgtcacttcatctggaagctgtttctgccctttcagaccaactgggtgaaattgctatgtgtgctttcttatgccatgtgtcactcctccatgccactggccacatttttttttttttgagacaaggtctcactctgtcaagccatcctccagcctcagtctcccaagtagctgggactataggcacacaccaccatgccagtctaatttttgtattttcagtagagacgggtttcaccatgttggccaggctggtcttgagctcctgggctcaagcaatctacccaccttggcctcccaaagttttgggattgcagatgtgagccaccgtgcctggcccactcagcacgtttcaatatgacacgtatctgtgcaatgacgccgttcatatgtgcctcatctcacaaactcgaagcgtcatcaagccagagacaatgttgactttgttcttcatagcatttccagggcaagcatggctcctaggataaagcaagtccccactgacacatttcattaaaagcagagaagggttagaagttcatcagccttggctggtgcagtggctcacatctggattcccagcactttgggaggccgaggcgggcagatcacctgaggtcaggagtttgcgaccagcctggccaacgtgtccaaaccctgtctctactaaaaatacaaaaattagcctggcatggtggcacatgcctgtaatcccagctacttgggaggctgaggcaggagaatcgcttaaatccgggaggcggaggttgcagtgagccccagaggagccaggtcatccccagtcagcacctcccaggtcaggtcctatttctccaattgctcagctttctacagctgcgcccactgtgggctgctcaccctcagagcccaggacaggtcctattcctcgaatggctccccgaatggctcagctttctacagctgcgcctgccgtgagccgctcaccctcagagccctcatgtctgcagctgatttttgtttgcagttggcccacttctgttccttattctgcctggaaccctgcaagtcattgatccctcattcaacctgctcctgggtgctcagcacaggctcagtggggggcctggctccagtccaggtcaccctgtgtaagcaccaaccttgacacttcataattaatgttgttgccaggaagctctgataaagccattcacaagcccaggtgatggtggaggaaatgtcattcttcctataaatgcttcccacatctcacttattttcatgacagggagctttttgctgtcaggtttttgcctcagacagaaattcatcgctttcagcgcattatccctatatcaacccttctgtcactgttgctttgcattgctgcattaataataataaaaaggaactcatgtttatcaagaaaaaacttcagagggatacattgaaaaaaacataaaaaatgctcagagattgagattgcttcttcaaagctctggacagacgaaaaacacattggttatttacatatcgacaggttcttcggtaaggtcaagagtacatcatttccaactaaatgttctaagatattaactgtcttttttacccatgtgaatatcataggaccgccaagtgaggcccaaagctatccgtttttagaaatgtatttgtagtgatagtcctggcacagctcaaatatatcctgaacttgacctgaattgtaaattaattcttaacgctttttgcaaaacaatcccctgcctttgggagatgggagaatgggtgctcctaaatcactcgatcatcacgagatttgctgtttgcaaaccggggcagactgccatctttacagactaccgaggaagaaacccaggaaagggcttattgtttttgagatttatttcaatcaagatctgaacccctgaggcctttgttaattttcctctgactcttcatgtatttcacccttgccttctttttgatttcccatctgtcttgctctttttagtttcctatcgaattttgtttgttttgtacactaattctttcttctatatgtgtctttgatttgtcccctaagtcctgacctgtttcaggctgtattctctattactttcatcctgggacactttcctttgagttgccctgatgggtgaactcagaccacagaaggtcaagctcagacacatcttgtggtagataatctactggttacaatttttttttttaatggttcctacttagaaactcagtcctccagcactcatacacataaactctcagttactttttcaacaaaagttttcttagtggtgaattcattttaccaagaagtattcagtatgtcacataaatttgcagatgtaatattttatatatatatatccaatagtacaacataaattcaatagtactataaatcacatttcaacttaatactattctgatgggtatagatcgccattattgatgagtagattatctaactcaacacttctcataggtgttgtcatgaaatgctggtgagtgagtcatagtacaaaaatataattttaatacaaacagatacttttgaggataaaagagactctattaacaattacactgggacaagcagcatacaacatgaactgctgtgggccaaccggcatgtgtggtcaccttagcgacaaccatcctgaagtgcgctacagatcacttgaaaaataaccacaaaactgacatgcaaatgaggcgggttcgacgagattgctcatttacaacccagcatgctttcctgagtgaaggaaaattattacaaatatttttggggttttttgtttgtttgttttgagactgaatcttgctctgttgcccaggctggagtgcagtggcacaatcttggctcactgcaagctctgcctcccgggttcatgccattctcccacctcagcctcccgagtagctgggattacaggcgcccgccaccacgcctggctaatttttttgtatttttagtagagatgggttttcactgtgttagccaggatggccttgatccctgacctcatgatctgcctgcctcagcctcccaaagtgctgggattacaggcttgagccaccatgcctggccaatatgtttggtttttaagttataaatattcctcggtagctttatatgaaccttcttacaaagtgccagcattatgggggccaataccttaaagttaagagcagatgagctagacaaagttaaccggaatttaatttttaggaaattcaaagtgaatgtctgtgaaaactagggtttataatttgcactagttcacaagttctctttcctgaattcccagggaagccagactcccacttaccaccttttgaatcttgaaacaccctcttcctcctcatccaggaccaaggtttcctagaaagctctatcatttttccagattaacttgaaatagacaatgtccatctgagatcatttcaatcttaaaactctggcttcaaactaaggttcaggtaatagtcttgcacctgagtcacttctaattcatttggtccccagttctgataggtaagaactggatggaaggtgccctctgttgggccagccctatgcgatcttcctctccctcaaactcccttcacgtggtctccaccgcccagttccatgagcagaacccaggagcagagcatggggttctttagatatgtcaccaagggacgtgccacttggggttaggaagtgacaaatctgtaagcagcaggaatttcttttccctccaatttttcacgcagtatctggagaagcaaagatctagatctgggcccagggcaaaataatatgtctagttttgggagttgtgtcctacctttctcaaaaaagaagtgcaaggatttgactggtcctaggcttccagagggaatttacaacaaacccagagagaagcagggccttggggcctgaaggagaattatcggcagcacacaatctataggagtaaagaaagtgtgacacatgcatctaggtataattttctggcaaatgatttctttctggtatgaaattgttgtaaattatgaatattgttaaaagggggaatcataatgcacttatgctggctctattcccagaaatagtataatatataatatatgttgtggaagggttcagaaacaccagtgttatatttctagttatatacttccacgtattattctagtagtttcatgcattttgatttttttaacctacaagtggatcagagcccctgggaggaggaaccacatttcattcaccactgggcaacaaagaaaagccagactgagactctgcacatgcacatggtcactgcccttccatagctttcagtccggtcatttcatagagttgtctactatgcaaataatcatctactataagactatacattgaggatatgctaaagaatatcaggtaactgtctaaaaagatatatatgcaattttttagtgcaatgagtattctaagattcagcagtgtatgctgttcacaatgttcatggcaaaagttagagagtgtgataattccctacagcactcatactaaagtgccaggcatcaaaataaaaaggtaaaggaaatgtattatcccacagttctagaaatccaaaatcaaggtggcagctgggctgctctacctctgaaacttgtaggagaaaggccattccttactcttccagcttctagttgtttgccagaaatctctggtgttccttagcttgtggcagcacaatttttattttcgcctccttgttcacgtgatgttttccttctgtttctttgcagcatcttccctctgtgcttgcttgtgtgctaatctcctcttcttataaagacaccagttattttggattagggcccaccctaatgatctcacattcatttgcttatatctgcaaagaccctgtttctaaataaggtcacattctgaggcagcaggaactaggacctcaacatatttctttgggggaggacacaattcaacctgtgacagatggtgttgctcttccgttagttgacatcctgggaaccatcgccttctcccatttatcttaatattctggtccaagatca

SEQ ID NO: 597 - DNA, 20001 bp, Homo sapiens
accgtttggtgaataaatgaacattagtctaatatttcactttgggatctccataaaaataagacaagtattgatggatacacttccacagtactgccaataaacttctagttccgcacctactaatgatgctatcaacatgattacaattattcttatttttaaagttaccattatttgagtgcttactatgtgcaaggtcatttgctaagcactttactaacatcatcttattgaatgctcacaacaaccctaagatagtaactactaaggtagacactatcaatagtccatctgcctgagatcacaaatctagtacttgcaagaccctggattcaaatccaggtatgactaaggccaatatctgtgttcttgttcacgacactatttgtagccacctgatcatgctttggaaggtattcacatatgtgtgaagaacgcctactcaccctggcttctgacataagaatgcagatctggggtataagtgaccccactcagagtgtagagacaagccaccaccatgtggacaggagccacctctcacgatttccactgagataggacttggctgccatcttggcatggttctcttcagtgccactgagcccttttcacttttagaaggacaagaaaaccctcactgcctgcttttctgagccaacgtggtcagcttgaattttaagaattgttgcttaaggtttggtaagacaaacaagtgacattttctgatggctcagactcttttgctccttctccccttcagtccaagcccatggcgcatcttgcgtctctgttgcatgtgtgtctcggcgcataaatcccttttgcctcagaactctgatatcgccatcatgacatccacctccagcaccctgcacaagggtgagcgtgggcctctaaccatcagctgtttcaccatgtcagtatcacagggagcaggacacacattccagagctgggtagattaacctccaagacgacactcagttttagctttagcctccctaaatcctcaacaaaagctttaacagccagaactgatttaggaccttaactgtaaatctcctctcttctcatgcactcactaaaggggtgatgagtaaaatcaactgggaccttttctggtcacttgtcccctgtgtcccctggaggattcaaggtgatagctaagaacccgcattatcaagaatcttactcaaaggcaggctaaaaaaaaataaaggaactggaaggtgaagagaaacattattaatggcgtctatcaaatgcggatttgtgaaaatatcattcatttataaaaatgaagccaacctagtagaatgttaaaaacagcagtaaccgaatgtacactcaatttttagagacttgctgatcagcaatggagccctgccatgagaacacatctccttttcactcaagcgaggatctgcaggggcattttcaaaagtaaataaatgtccacaaagaacaaaaaaagatcagtagagaattgagtctctcaagaacatccctgacaaaataaaccccatgtttatgtatgctccctccattggcctgagccagaaatgttccctgcaacttgaaaccaatggcacaggagttgagagaaatgtccggaattagcttagtcaaatgctgccttcaattaatgctcctctgctgcttaatgagatcccagggccaaagcagtttagtttgactttagcagttcccacttgttttggccatgatgcatcaccttgccttttctttggttatgtggcatcttacatagagacacctctttaaaattccaagtggcatattttgaaatagtgtctagatttttttcttataaaggttgatttattgtaaaaaaaaaaaaatgtttaaaatccaaaattcatagataaataaaagccacctgtatcccattttgtctcaatctcttcaagtacatacaaatttaataaccatatacagacactatatccttttttatgttatttcatatcttcaaaatattgttttactccataacatttcatcatatacagtagacattcaaatgatctcctaatgtttgattactttcaaatttttttgctatgataaataatcccttggtgaacattcttgtatgtaaaattttatctgaataaccaaggattgccttaaaataattaacaagaatttctgagtcaaaggtggcagattgctggagatggagggtaaaatagtttcatctgaaaaaaaaatgttggcaaaggtcaaggtaacttcagattcagccaaagtaggctgggaaaacttcaaaaagtggcccaatggtgtaaatggttttgataagttgggttccagggacatccaatgtttattaaaaaaaacaagaacacacaaacaaacaaaaactccagtgaagcaagcagcacatattgcatatccatgatccaacctgtcttcacctgccattctacaatgcattgaaacccatgacagtgtagtcaccatcttggactagaagtaactacaaatgaaggctatctcagagaagccccctacgtgccactatgcttgtcccactgtgcctgctacagggctgagaaaaggactcaactacagcaaagcaagtcaatattggatacagtcaggttttctacttggcccatgctaccaccaagataccatgtccaagagtagggtgagagaaagctcattttttaagcgatctctgcttaaagtctgaatgaagttatatcctccctgagaaactgcatcctttgcaaagtggacaccatattgtgaacttaggctttaaggaaaattcaaaacaagtgacctacaatatgattatcattttcttaaaattatacctggaaattgttcaacaagaacatctgctcaggaacagcagtccttcattagactcacattcttgaacgattgaattctacagaccctgactttgattttgaagactttttgttttcctgagaggtcagcctcaaatacaactgctagtgactcaaattatatgtgatctcttctcactgtcacatggcataaagtccaccatttacaatttggcaccaaaaacccagtcagctaaatctcttgtcccctatcctttatgttcctttatgctaaaggtttgtaaccttcatgcttatggtttggaactctaactcatttgatgtttcctaaactctctgagctctcttaagcctccccccatgtaagtcctcacccctgcccattcctggtctaaaaaatctcctatatttcaagaatgatcacaactcctacctctccctctaggaagccttcccaagttcctcccgacaggaatagaacatcccacctcagttttccaacggcacactcctccagaaccacatctgtcacattgctctatgactgccacttaccaatctccccggaatgagagagtaagatcctcgaagataacaaccatgtatgttcatctctgtatcctcagaacctgagatagagcttataaatatctgcttgattccggaacaacaaatgataaaatgctacctacgattaagaaataattgagaatccaaaataaagtaacaaagaccaagagcctgaagacactctagctgtaaaccacgtgtgtgtgtgcagagtatcatggcttattataaaaaaaaatatgctggaatgtttgcaaaaccaaattgtattaacaaaaaacatctgcagctttatactgtgtgaccataatcttgatttttttcataaaatgcagaatatcatttataacaataaatacaaactctataaagtctcttcaatataactcaaacctttttctttggtgtgctctaaacatattttacgtaaatgatgccaaagtctcatgaaaatatacagaaaccggaagctcaatggcagcagatgcagagactcctcacagagttactgagggggtaaatagaatctaactcaggggccaggtgtggtggctcatgcctataattccagcattttgggagactgaggcaggtggattacctgaggtcaggagtttgagaccagcctggccaacatggcggaagcccatctctactaaaaatacaaaaaattagctggttgtggtggtacacaccagctactagggaggctgaagcaggagaatcacttgaacccgggaggtggaggttgcagtgagccaagatcatgccactgcactccagcctgggtgacagagcaagactctgtctcaaaaaaaaaaaaaaaaaaaaaaaaaatctaactcaggggccaccttagatatgaagagagtactggcttttaaactaaccgagatctgacactggatttacttaaaatctcaaatagtcttgtctttcttacctttctgccaagccaaaggggcaagggaaactgctgtaaaaatgaggtgctcacagactacgagaatgaggaataaatattggagttgtctagagtagcttttcacccaaagaagggatccattccgcagtgtccctgacaaatggttgccccagtagttctatgcctgttctggttgctggagtggagaagataggagagcactctccctccaacgactgactttctagtggggaaaaaagacaaaaaacaagtgaaagactcacaagttaaaaaaagataatgtcagttaccgactccagctattagaaaagaatggatggcagatggaaagtgatggttcctagaaaggggagaagagaagatcttggaaattatgatatattggctgggacttgaagggcaagaaggagcccagccatgccaaaacccagaaaagcattccagttagtgcaaaggccagtgtggctgcagcacagtgagcgaggagggaggtgatgcgacggcagttccaggagaggcaggatcattctatctctaacagagagcagcccgtcactgggagatggtccttcccatatgagctggacagctctgccaggaggtgccctcttcctgagaactgaattcttccctcctatcatttaccttcagaaacttcagttttgagctcgggttcagatagcagcattacatctcctccttccctgagacaacccaaaaataatttaaatcagagaaaccggcccaccttctcttcccaggactcttttccaggataaacctattttagttatccaccccttcaagataggattcacaaacccttcccatcctgttcacccttttccaaatactctctgattagccaacacccctcctcaattatgccagaactgagcaagcctccaaaatgttagaggcagcacagcaggttggttatgacatgaacttggtttaaaaaggttccagtctgggccctaccacttatcagttgtgtgatcataaccaagtcacttaacctttctaagcctctgcctccttatctgtaaaatgagaactatagtatctaccttgaaggattattgtgagaaataagtaagaatatatatgaagttccaagggctgtggatggcatatagtaaatgctcagtaaggttaagctagtacaaatttgatgatgatgataatggtgataatgggatcacaatcatttccatcttgatctaaaatctgcatttgttcaaattcaagtttaagatatatttgttgtgccgtgttgtgttgtgtttgctgtagtagagtaggggaatagcagccatttacagttctactaaaacttttcccccagatcttttgcatataatacaatcactctaatctgatcacagtaacagagaaagatcaataaagaactaaaccataaaattgggtacatctaggctccaattactgcaggaatataaccatgtccgtatcacagagataatgctgcaaatacttaaagaatgtctgcagatcaccttcctggaggcaaaagaaaggtcttattcaccatcgttggagcaaatacgttagtcctcaataaatactagtaagagtggagaaaggaggaagtgagttagaggttgctctaggctaatggtatcacatttgatgatcaaactcacacaatgttagatctcaaggggacccaaatgaaacatattataggcatggaaatggaagctcagaaaggtgaaggcacttgcccaaggccacaaagctaacttgggtcagagctgggtctcttaatctcttcccagaggccatcctaggcaaaccagttgcagacctgagtccctctggacagggcctcttgatctccttcaaagccttcttgcagaaatgtcctctgagacaggagaaagtcaggtttccccatttccatggtttgtaaccctaactcatctgaactgagagatccttagggagtagaaagtcaaggctggcatctccaaagctgcataaatctctcacctaaggaacatcatcatttttctcttgtcacaacccttccagcctaatatttgacagctctgatcgggtactgtccaaacatttattaaaacattttaaatgatgaatatatccaattattactattaatgtagctaatactgactaatgagggggaaatgcaggagccagtgtcccgcaattcattacccctgccttgtcaacaattcaaagcccgaaacctaatcatccataccgggccctgttatatttcacacgtcacttttaataagtcactcagtgcctataaattaatgtaacatgtcggcgtttatgagtgcagctttgtcgccgttaacaaatgatgttctggcccactctacaacagctaggcagtgacgaatgatggaagatgatttctttccaaactataaactatacactggggactccagtaatatatgtatatatatgtatatgtatatatatatatatatatatatatatatatatatatatatatatatatatatatatatataaagccacatagtgcatatgtctaagcacatacagacataccacacaaactaacaaagcatgccaacatacacagaggcacaaacatggaataaatatgatgcataatttttcacaaagagctgtgcaatatcccctgtactttcttctctaaaaggttaaacatgcagcactaggaaccatgacagtcccataaaagtggtcaatgttaatttcaaatttgttgtaagttctgctctattgtgcctggccaggtttcaggatagcctgacatcccagctaataatggtgtcaatgaaaggagagggttcacattacgcctagaataccagtaattagaggaagggcctgagtttttatgacaaaattggtggttgttgggtgttgggttggaagaggttacttatttgcttctaaacagacctgaataatctatatcttcttctaagccatgatttcatatgtgaaaaaatcattagtatgtaatttgggtgtaactttacctccgtattttcatctaactcaaggttcaagatgggatacagtgtttctttaactggcgaccctttttttgtttctttgcccctgtcagaggcagctctggaactacagagacactttgggtctttgcacacctggattgaacaccatacacagcgacaaaactctaggggcaaagaaggcctgagatttccttgggaatcaatctgcatacaaggtcacagctctgtgggctgagttcttagggcagacaattctcacctgccttagtttgcgggaagaaaacacctctccatttattggagtgtaccaagacttccatatggttagatattttattgttaatattttctttctccctgtaatcctatcttagcttcagagctaattattacaatggacataaaaaggaacaacatttgaaaaactagatacttgaaaagtttgaagtggattttccagggttgctattatggctcctctttgatgagcattcgaccatttcagactctgccttcatttgttttttctacttgcctacaaaactcagaagatagcattaccatgtgactatacaaatcctacaaaagcttaattttttttttctctaaagactgtatatctacatctggaaattctttatgtagttctgacacaaggatttcgctcaaatatcagggacgggattcaaatcagagttccccaagaaacaaacaacataaaaaatggctcctattcattttttttttgccatattcttcattctgtcattgaattatcattaagaaataatagccttaggatttaaatgtctagacaaagattcctgttttataaacccagagtttatagagtttaattttgtgtgtatatggctgagagtttaattctttcaacttatgtgttagagatgttagagagctaaacatgctgcctaaaaaaaaatcactcaaaaatttaaaggaaattaagaagagagctccaaacatgtttttattacatgtctattaggaaagtacttgcattgcacttcatctggcagggaacatactgcccagttcagtcttttgggtttgtttgtttttttctgggatctgtgaatgtctagttcaaggactaacacccttcacgtcccctaatacattagagagaagttcacagtgaagaaagggcagtgcttttttgttatgtgaaaactgagcaacgtctgatgctcaagaaaatggcttcaaagtacggtctggagtcacacgtcacacagccacacatggtgtgcaacagtacagactagcagaccaataagtcaagtgattacatggtgcccctgtctctgggtgtttgcacaattttcatgcagtgaagatgctgaaaatgctgcatagtggtcaagggccatggcaatgctttgctggggacaaaagggtgggaatgtcataagcaaaacttgaaatgatttcaacatggttgatgttgaaagcattaacttttaacctactcttgaaaagattcaaaatgacttcatagaatcaactaacagcaatcgaaggaggtttcatgttctcttgacaaagccggaccaagaaagaaaagaaagatgatatgtacttttcctttggaatcatgaaatgtggcattcaactttttctccgtccaggactggtgttttctgcagtgtgtcacaggaaaaaggcacttggtttagggtgtgtacgtgtgtgtatgtgtgtaaaagtaaggcaaaaatggaagacaccagaactctggccgccgtatggaagaaaatgcagaatgctgtctgctctggttgctctataaagatatcaacccaggaggagacagctgaaaagtgcttttcccagcagagagggcttcacaaggcgcagtgagatccccctgggaatagaacaatttgcataacaatgtgctgttgcttatccgggaggacccaaaggatctggataccctgagagaatacaccacacttttcagtccagcccactagagagaaaggcattgccattcagtctgtggggtcacaggagggaatacccgcccccgaccttttaacatcatttcattgcatgaaatccttgagaccctcctatttcctcttctccaaacattctgttttcctatattagtagtgttctcttttttttccctaattggcccagatcctaataaacacacacacacacacacacacacacacacacacacacacgttttgttgtttgttttgttttgttttgatcttttgggacctacccaaatccaaggtctccccatccccttttcacttcactctgccttttcatccaggccagtgacttggaatcatgcatgacatattcactacttgatcttgtgaacactggaaagactgtctttattctttcatgaagataattggagagtctattctctgtgctctaggggatacctattttgtttgcctttcttttgaatgagaaagaggcatgtctgagggtgatatttattcctgctgttttgttttggggaccaggtagggaggctgttgaagaaagccaagaaaacccagagaaggcaaaactctaattccacaatatgccaaatactcataaagagcaagatttcatgctccaaagctgccactgtgtatcaacaagcagtgcacttcatgccaaaacaaagttttttttccaaagcacattggcaaggactagatttagagagcccacaacagaagtgtgcatgccctccacttcaaccaaaggcaaaatagcatttggccatgttattaaaaatacactgttcataattgaggtgatgtgaacattctgctcccctcctccagaaaggactgggcatttctggagttccaccattactagatgtcataatttaggacaagaaaataaagttagtaataggaagcaataaaatttcatttagcatctgctatagactgtggatgacattaggcattttcaaatatcatcaccatctgaagattaagaaatctggccaggtgcagtggctcaagcttgtattaccagcactttaggaggtcaaggcaggaagatccctggagctcaggagttcaagagcagcctgggcaacatggcaaaaccccatctctacaaaaaattagctgggcactgtggtactcacccatagtcccagctattcaggaggctaaggtaagaaaatcacctgagcccaagaggtcaaggcttcagtgagccatgattgcaccactgtactccagcctgggcaacagagtgagaccctgtctcaaaaagaaaaagaaagaaaaaagaatgagaaatctgaggcttgcccactagcccacaaccacatagcaaggtctgaaacctgaaccaacatctggttcacctaatgccctggctctttgtacttgtttatatttaacatagagtggacagggcatcagaggactctgcaagatcatgaggagaatatttgaaggaatatttagtctgatagagagaagtcttgatgaaacaagatagctgtttccaaatatttgaactatttactctttgtacgaagcagcaaacttacaattaaaaagtctataggacagactgggaccaaagcctgaaaattcagtcaagaaggaacactctaatacgacagaaggaaaaaaatactctctaatagtgaaggggctgccttacaagatgaattccctatcacagcacacattctagaaaagaccaggcactacttggaagaaatatcagataagtgaggtgctcatctagctgctactactttcccttcaagccttagggtctaagaccagcataagcttggagaggttcaacttctgacatgcagattgctgcagaagacaaattaagacattaaaaccaaatgccaggtagttagaaaaaacaaagttctgcatgagaacaaatctgcatgaccatcccctcctgacttaaaaaataataattaaataaagttctagacacatttgggctcccttggaaaaaaatgccatacaattgcattaacacaactgttgctattaggaatatttacctaataataataatatgtagaacaatcaaaatagggaggaaatagccagaaagtcattcttgcagatggtcacatgtctagggaggcagaaataagaaatgtttaacaagcagtcttctttaagttatgacaaatgatgctctgactttataaaaccccctggccaaggatctgaagtccatccccataggtggaaacaggaatgatagaatcataaaatgttacaatggagaacctctaattcagtcatgtctttccacagatggggagatagaagctcagatagcttagtggatttgctcaatgacgcacagttcattcattgcagagttggggccacaaccttcctcagacctagccttacgatccaggatctcttcctacagcaatgcaccaaattcatttttctagaattgaactaaaaacaaaacaaaacaaaaacccagacagcaccagcttggaacagtcaggtccaatgggatcaaagcctaaaagaaggcaggtagttaccacagcaggtgcagagcacttggtggaattgcagccatggcttttctaagaatatggaaagtcagtggaaagaattttacaaaacatacttcacaacctaattctgttgccaaaacagacactaataagtagtcaggagagatgcagtcatcccaaccccatgatggtcttaagcttccctctgcctttagactggactttcctatctacccaagtagaaaacttttggtcttttcttttctttttttttttttgagatggagcctcattgtgtcacccaggctggagcccagcggcatgatctcagctcactgcaacctctgcctcctgggttccatcgattctcttgtctcagactcccaagtagctggaactacaggtatgcaccactatgcccagctaatttgtgtatttttagtagagacagggttttatcatgttgtccaggctggtctcgaactcctgaccccgcgaactgatccaccagccttggcatcctgaagggctgggattacaggcgtgagccactgcacccggccctgtttttggtcttttctgattttggtgatagaatggaaggaaatgagaatgcaagacattcatatctgaattttaattttaaaacctgcttagcacacaattcactcttgtcaagtgaactgtcgaaagctcctaagaactacataatttattcctgggccaccacccagtgtacaaacataggcatttactctgtgggatacactggtagatgaaacaatgatcttatttcatcttcaatcatgcttcacttttcttttctgtgtgtacatttttggaggaactattagttaatcagagccctgctacataccattaattcagttcaatacaatgggtatgtgctaagctgttacaatatgccaggcactgtccctgggtgtagaccagaaatctcccagagcacattccctttgaataacaaaacaagctaatattttggctttatcaaaagccatacctttgtccagggctcttcagtcaagaatgacactaatttttttttttttttttttttttttttttactgctaatcaacattacaagatccacaatggcttaaaacaacctgaaaaccttcattcattaatgatagtcaatttctccctcaactctgacttactatagtggaaatgggactcctgtgccattagaaatgattttcatcaatacaagtgaaccttcaattagaaaagccgactgaccagaaccctagttagtggggattttactgtctaaagacaaagataagtgaattgcccaaaagtgcacgtctttacccccactagcatcttagattctacatcctctttttatgcatcactcaacccttccattccctttgactctatagaatacacagctctctagagtgattcgccacattttggcattgccacagtgttccctgaacttcaatcactcataacagcaccttcagagtttttgccatttttacctataataatattcacttaatattttatgtatactgactcatttccttttatccctaataaacttatttttgaatgacactttccattcctactatgaatgaaaacccatactacttatctgagataaaagaaagcaacataattaaaagtgaatgtaaacaaaattttaaaaatttactaaattttggctagatactgttgcctaccacagggtactcattgaaaaccaagatgaagcaaatgtgagggaggtgttaaagacagattcccaccaaacaaggactttggcctcatcaggaaaactaaaagaaattttaaataagatgatttccttatcacctaattcagtgctatttaaagacacctacaggtaccacttaaaagcatccagcagtatgtaggtatacagtgagaagtaccaccaccagcagtatgcagatcaacagtgagaagctgcgagttggctaatataggtatgggaaagctcacatcacacacataagggaacacaacctgtatgatggaaagaaggctagagagaaaatattgatcagcctaaagagaggagatggaggattgtttgttagtgatttgtatagagttggaagttcctaggccagaggaaaattcatgagtttccactggtagaggagaaaactagaatatatcagcagattatgagctgccatgaatttttctgtttttcctctttaaacatggatactgataatgaaataccagaaaagtacactctgtggtgaatctggcttttgatatttattaacattaaatggacttttgcaactaaataacaccaaaaaaagagagaggagatacaactatagtatgttcctatagcatgttcctaccctcaaataaatatcaagaatataatctatgtggaagaaagatcaagttggcagaaaagggaaaggagaattaggaaagcaaaataaataggtgcagagaaactgtcacacaagtgaattgagactcagtatttaattagggacagcaagcttgcaaggctcttggtaaatgtctaccgaaaccaaccacgtgttggttaacactgagacatacaaactgatcaatagtacaaaacaaaagggctcaggtatgcatgtaaagtcatacatcatttcaataaattacgctgtgtgtagacaggttttttttagaacgatcattctgagatcaagagctaaatcatctcagccacatcttgatttctgcaagactcggcaggaattatgaggcttaacagcattctgacaattagcatattataaatacaaaaatgatatattaaagggagaggaggaaaaaaaaggccagtgttttacacctacagtaatataattccactacttaatgcaaagtaacaggcctcagagtgtttgggatcctcttgtatggtgttatcttctctatcagtaaatgagactatgtgaacagtacaacctataaataattcaaggcctgagatggcaattatagaaccatgcacaactagcatgaatattttatgaaggctaaaacagctctcagaatgaatcatggagagatgaacacacacaagcacacacacacacatacacacacacacacacacacacacacacacaccaggcagttttggccaaattgtatttccaagacaaggcctctctttgatctctagaacacctttattttatggaaacagtgatgatagttacatatttttcttttcttgaatttatttcctaaaatccaaacagaggaatgaaggtatgaatttgtcaatagggtagaggagcttgaaaccgaggaagaaggacaaacaatttttaacctgaacttctgcagataattccaagtgatttttttaacctttccaaatggactctacaaaaagtaccaagttccaatgtatcaaaattgaaactgaaaccagtgtcacttcatgactcaagcaagagcacttcctatccgaaaacttccctcatatacataagcttttatttctaattagtccttgaggaatacctgtaatccctgctttcactacattcataagacaaaacaaatattactgagccataagcctgagcaaacaagctactatatttaaaagtagcagcccagatgtcatactctattaggaaatgagcaatgcctaagttctgagctgtttctgtaaccaaaggatgtgcacagctgaaaaaaatgaaattatatgaattcacgtcttgatttccctgtgcaatgtacttgtgctatttgaataagagttaatattcatttgaattttacagagattagcattcatcatttttacctgcctcctatttacatatacccagatgatatccatgtggttacacaaaacaccattgttttcctaaagtcaattttagcataattcactttcttaattacaacctaaaactgtaaagacttttcccagtccctccacagaagaatcttaaatttatgacccttttggtatgaatatgtgtgcttttcacttcattacaacaacaagaatggaactttaggactctaggatcttagcacaggaaggaaccttagatatcttctgatccaactgcttcattttgtggatgcgaaaagtttagaggccaaaaaactgttccatggcatattcggtatcacatgactagttgaaacactacggccaataatataaaatataataatattagcaggaacaaaaatcagtaacaacctcaagtatttacagtgagcttgcaataaagcaggcactgtactttgcaggcactgtctcctttagcctcccaatacctctaataggtagtattattattgtctccatttaaggatacgaaaactgaggcttagagagattcatgtatctctaccctcaatcccacgaccccttttccctctagtgtactcttcaggaagttacatcagaattctctatttgagtcttggctagaagaaactttcattacatggaccagttattactggagacttcctagatgggagacacactgatgttttcggtctcactgagcctgctgctttgtgagacctccgagggcatagagagaaaaggaagctcctacaacctgtactgcaagaacttcaggaaaaacaacatctttccataaaaagtttcacgttgccctattattcagtttaagaagttcagagccactgttccatgggcctgccttttgtgttcaatttggaggcatgaaaatacctttagaatttgtaaatctcaaggcaaccgagtgaaacgccacctaccgcagcagctggagggcaggccagtgttatgctttgatagccccctttcgattgtattaatacaaaggaaattaaaaaatagcatgattctctccctttcttctgctcatgcccagctttggattttcataataggagggtaacatttagaggtcttttttacattcgtgcactaacctggtacaaatagaagtaagctgtttgctgttttcttttaggtgctccaaaatatgcatgactttagaccacaaagtcagagaaataccctgttttattgtaaaagtgtaaagaactgagcaagtgaactggcttttggcatgtattttcttgaagcctctatctccaccaactccttttcctactgcacccagattcacttcagttttcccacagttccaagcccacagttccaagcccaactctgagaaggtgctgagaagaggaaatccagtaactgaataacagccactctctggactcttgcccctattctttttgtatcctctagggagctacagtgtcacttactaggtgcatgcccctgaatgggttaatcttttcttttccttatttcgacagccatgtttaccttttgaaaaggcgagcagaggcacagtatggcactggagtgctaactgctaacacatgggctatgctacatctcggcaaaaatttctctcatacttgtaccagcgtcccagccaagatcaacaccatgagtttgattttcttcatcatgaattgacagcttatttatctccatggaagaactttctaagccctttaggcacccaggcaacttagaaggcattcagctgactgttcaaaaatattattgcttcatcaaaaatagagactaaattatttcattcctgttaggctgttctctttctagagagacattttagtgaccctgagttatgataatagtttataaccaaatactacaaacgcacacacacacacacactttccaattggtattatattttgaaaacctttttagacctaatgttatgctgacagtactaagttttgtgaggatgcacaatttccatggcttccttttccaataatggttgggaagcctcattagaataattaggaacgaagtcatttccggtcgccatatattgctctggaaataatagcttccagtgcctgcaaaaccagcaaggaatagaatgcatatgccaactcctgagtcacaatggaaaataacataactccatgttgctgtatggaacctaaaccaactgcaactctgtcaggtgctcacgtccaaagaaaacttgtcactgctcacgggagaagtttaaatcaatttgcaagcagaagacaacccagaaaacactaactaattgattatgcaaatgcagaatccaaaaagtattttccctagtaataaatcacctatgactttgcaacgaacagcaatgagaatattgacctgctttggagtgaggacagatctgtatatataactatcagcaggaaaaaaatgtatatgagcatgagaaagtggcatgggaagagagagaggaaagagaaagctttactggttagattggagggacttgtgaccacagagcctcccaaatcaaagctagtgcccatttctctaaaagtatctcttcaattaaggcactggtttctggtgttatgacttccacataacagtaacaagaggaaatatttactgaatccttattgtgggccaggtgccctgctaaatgctatgtctcatttaatctcattatctcatttaacccccacaacaacactatgatgtgggtatatactagtactgccttcatttttcaacaaggaaactgacactcagacgagtaatttgagcaatttccccaagatcacacatttctacttctagccagccttttttttttttttcctgagacagagtcttgctctgtcacccaggctggagtgcagtggaatgatctcagctcactgcaacctccgcctcccgggttcaagtgagtctctttcctcagcctcctgagtagctgggattacagggatgtgccacggtgctcagctaatttttttatttttagtagagatggagtttcaccatgttggccagggtggtttcaaactcccgacctcaagtgttccgcctgccttagcctcccaaagtgcttgctgggagtacagctgtgagccactatgcctggcctagccagcctaaatttgtttacacagtcctaaagcccaataaacagaaaaaaagaatagattctcttcattccaaatttgcaaccaaaactcccaggattttttttctcctttggtctagtctacatccctattattcactctgctgattcctgccatccactctgccttattatcatcctctatgccccatctgttttctgaatgttttgtttgtaaacgtctggcataggatggttggttcagtacagtatgtaactgggcacatatatgtgatcaatgatcacaatggtgaacatagaaactggaggcatcttatatgtcttcaatgtggcaacatatgattctaccatacacagtgtttgcaagcacatacgctcaaggaagagagtacatgcgtcaagatgggtttggcaaagaggctgtcctgagaaagaggaaagttcaagtggaaacactcttgggtgtttctacctgaaagataatgaatgtgagaaaagaaaggcacagagcaaatattacagaacctcacaggaagaagttatatagaaaagagcattgtgtggaaggcaatgctgagaagaataaaatcatgttgaaaagttgtaggcattgatagacatttgggatggttccaagtctttgctattgtgaatagtgccgcaataaacatatgtgtgcatgtcagcacaccaacatggcacatgtatacatatgtaagaaatctgcacattgtgcacatgtaccctagaacttaaagtataataataataataaaaagaaaagttgtaggcaatttgagtttattagaggagaaaagaaacggacaggagggcaccccagccctggagtagccccgattttgaatctgtgtagtgaatattaatcgctcctatggttgaaatacttgagagcagagattgggccacacgcctttctgtgtctgtctctctctctcccgaaccaggctttctggaacatcagggcaggaagggtgtttagagatcgcctggtacaatcacctcattttacacacacagag

SEQ ID NO: 598 - DNA, 20001 bp, Homo sapiens
tggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacactgcctcagatggttatcaaggggtaccctaagaagaaatcatctcaccctctctttgtccccatttgtcaagtagcagtgaggccgagccaggggatggtgaaagtggaaggaggtgggagttgggcatcgggtgtgaagatgctcttgaaaggggttttaataaccacttgctaccaggccagtgaacacttaccatagttgatgccttttgagcatgttgcattgtaaactgtccctgaaattactgtgcacttggcttatgggatgaaacatcctcctagttcttttgtctctcagcttctctgaagtctcattgagcaccttctcttcaatttcttttacacagtaagaataggatcagctgtgctaaactaacaaatacccagatatccaggtttggctcatgttacacgtccaaagtaagtcatgcaggaagctctgctcatcatcgtactcaggaagtcaggctgacagtctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacgtacattctattggtttgtgtgtttcttccaaatgtcccctagttcacaatagaaagggcttaaatagagaagtaaaggagaatttgggaatttgaagcaaaagcaagaagccactgaatcaagcacaaatattgagctttgataaagattggaataagaaacataataaatgagacaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagactgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagataaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaacggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggtgtcctcccacatttccaggagcagatcatgcctcttacacgtgtgattctagaacatagaatggaacagaatttttgagatcattttatgaggttggttcatttatatttccagagccagctaagaatagtacaggagaacaggattgtggactaattttagccatgtcactgaatccaacagtacattataaaaacaatacgttttgaccaattttagatttattctaggaatgcaatgattcttcagtgtcagaaaatatataatgtggttaacacattagtggactccgcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattcctgctctgtaacatgaaataaataagaaccaacctccagatgtaaataagtgaacacatgagaagcacttagaatagtgcctagaacatagtaagcaactcaatgaatgtcatttctcattacatttgttaatgtttttatccagcccaatggcagtaaaacatcaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggtaaaattttctgtttgagacatactgaatttaaacttctaggggaaaacatacagttgatttgaaggcagtgaaataaatggatgagtgtcatgctacattaggttagtgacataaactggaaggaggctcatggtgggtgaagttctaattttgggtcaggtcactcaagaaaagtacacaaagtcaggatagcagggatctgagtgtgtgctcctgcatccagacaaacacagacatgaagaaagaggctgaaaagcagaggactagaaattggtaggaaaacagagaggaagtgggttcataaaagacaagagacaggagaaaacttccaggaaagaggagagggggcatctcaaacacactaatgacacacataagacagaaacagaacagtgaccactggcttgagttgtataaaagtcattagttgccaccctgagaggagcatcagagatgagggaaagaaaaagagagagtacattgggttgaggactgaatgaaatgggagaaaatcgataataggctgggcacagtggcccatacctgtaatctcagtgatttgagaggccgagacaggaggatcacttgaggccaggagtttgaaagcagcctaggaaacatagtgagagtccatctctaagaaaacaattttggattccctgccttccatgagcaacacagcaaacataagctctgcagatgtgctcagacttgagcctgactcactgaagagagtgtggtgctgccaggcctcagacaccagattataatcaacctcttcccaggccctgcacaggagaggcccactctgtggggcatacagtgcccaggggtggtacaggccctgcagagaccacagactgttcacctgacaagaaatatcttgaggaactcacttcacagatccctcaagaaaggaaccactgcaggagaatacccagaaaatcgaaagaattcacagatccttttaaagaagggaggggccactgcaaactccaccagacaagtgaaaaactgtgcgttcccaaagcgtgagaggggaaaaacctgcctccggacccatgtccccactggggaactcgaaaatccagattacaggaaaaggatttaactttacctagacctgaaacagatttagcatgaaatacaaaagtacgccgggcgctgccgctcacacctgtaatcccggcactttgggaggccgaggcgggcggattacaaggtcaggagattgagaccatcctggctaacacgatgaaaccccgtctctactaaaaatacaaaacaattagccaggcgtggtggcgggcgcctgtagtgccagctactaggaaggctgaggcaggagaatggcataaacccggaaggcggagcctgcagtgaaccgagatcgcgccactgcactccagcctgggtgacagagtgagactccgtcgcaacaaaaagaaaaaaaaaatatatatatatggtagatgcagcagtgagaagagccttgtaggcacgcccagtctttagctcaagcccagggaagccacccctgactatatctcacaagggccctgggggaaggcagacggcaaaatttggaaggggtcacagtgtgaaaggagcgtccaactgaaatttgttataattctgactgggcacaaatcctctggagcagaatctgggggcgaacggaactgctggagaaagagcagaagttactgccaacattgtgggcagacagggaggcacatggcctgaaagctgtgcttgctttctcagcaggaaacttatagcctggagtgaggtctgagtccatcctgaaggctgcagggagataaattcaatgctgttagtgtggcacagcaggagcaaaacctgcctcgccaactgcatgggagctgggtgaagcctattgctaccaggtttcccctacttctctggtgacagaggcagccataatgccctctggaacataattccattggctggagaaaaaccctccgccccatccctcacagtggctgccgcaagccccccgcccgaggagagtctgagctcagacctgcctaaccctgtccacacctgagggcatttctctacccacctggtagccaatcacaaaagacgtaaactcttgggagctttatgacaccactcattgcctgagaaactgaatatttatcttggccaacttagggcaagcttatatccaccttctactattgtagctggtgccctcttgaaagcaccacatcctggctggaggccaaccaactcaggacattacaacaattcacgacagaataactgctctaagaaaggagaaaacagctaattccactggctgaaaaatcttgactaaccagtggtcttcggtctgttcacatgacaactgcactgctagcataaccagcatttgagaaagccaccacactaagtctatctacaaccaaggattctcacagagtctacttcactcccctaccacctccacactggaccccagcaatagatccaaactaagaagaaatctctgaattgctagatagagaattcagaaggttgattttaagctactcaaaaagataccagagaaaggtgaaaaacaacttaaataaattttttaaaaacacaggatatggattaaaaatgccccagggacgtagatatcataaagaagaaacaatccaacttctggaaatgaaagacacacttagagaaatacaaaatgcactggaaagtttcaacaataggatccaacaagtagaagaaagaacttcatagctcaaacaacaagcctttcgaattaacccagtcagacaaagacaaagaaaaaagaactttaataaataaacaaagcctccaagaaatttgggattatgttaaatgacctaagaatgattggcattcttgaggaagaacaaaaatctaaaagtttggaaaacatatttgagggaataatcaaggaaaacttccctggcctcgctagagatctacacaaccaaatacaagaagctcaaagaccacctgggaaatttatcacagaaagattatcgcccaggcacatagtcatcaggttatctaaagtcaggacaaaggaaagaatcttaagagctgtgaggcaaaagcatcaggtaacctataaaggaaaacctatcagattaacagcagcctataagccagaaaagactggggtcttatctttagcctcctcaaacaaaataatttccaggcaagaattttgtatccagcaaaactaagcgtcataaatgaaggagagataaagtctttttcagacaaacaaatgctgagagacttcaccgctaccaatccagcactacacaaaatgctaaaaggagttctaagtcttcaaacaaaactccaaaatacaccaaaatagaacctccttaaagcataaatctcacagggcctataaaacagtaatgcaaaggaaaaaaataaggaattcaggcaacaactagcatgagaaatagaacagtacttcacatctcaatattaacactctccacttaaaagatacagaatggcaggaaggataaaaattcagcaaccaagtatcttcagtcttcaagagtcatctaatgtgtaaggactcacaaaaacttaaggtaaaggagtggaaaaagatattccatacaaatggaaaacaaaagcaagcaagagtagctattcttatatcagtcaaaacagattttaaagcaacaacagttaaaaaagacaaagagggacattatacaatgataaaaggataactccaacaggaaaatatcacaatcctaaacatatatgcacctaacatgggagcttccaaatttataaaacaattattactagacatgagaaatgagatagacagcaacacaataatagtggggacttcaatactccactgacagtactagaaagtcatcaagacagaaagtcaacaatgaaacaatggacttaagttacactagaagaaataaacttaacagatatttacagaacattctactcaacaactgtagaatatacattcttctcatcagcacatgaaacatcctccaagatagaccacataataggccacaaaacaagcctcaacaaatttaaggtaatcaaaattatatcaagtcccctctcagaccacagtggaataaaattggaaattaactccaaaagaaaccttcaaaactatacaaatacatggaaattaaataatttgctcctgaatgatctttgggtcaacagtgaaatcaagatgcaaaattctctgaactgaatgataatagtgacacaacttgtgaaaaccactcggacacagtaaaaacagtcctaagaggaaagttcatagcattaaatgcctatatcaaaaagtctgaaagagcacaaatacaaaatgtaaagtcacacctcaaggaactagagaaacaagaacaaaccaaacccaaacccagcagaagaaaagaaataacaaagagagcagaagtaaatgaaattgaaacaaaaaaatacaaaagataaatgaaacatgaagctgattctttgaaacgatacataaaattgatagaccattagtgagattaaccaagaaaagagaggatccaaataacctcaattagaaacaaaatggaagaaaatgccactgatattacagaaatataaaatatcattcaaggctaatatgaacacattcacaggcacaaactagaaaacctagagaagacagattcctggaaatatacaaccctcctagaataaatcaggaagaaatagaaactgtgaacagaccaataaaaagcagaaagattgaaatggtaatttttaaaaaactgccaacgataaaaaatcacagattcacatggactcacagctgaattcaatcagacattcaaagaagagaattggtaccaatcctactgaaactattccaaaacagagaaggagagaatcctccctaaattattctatgaagccaggatcgccctaataccaaaaccaggaaaggacataataaaaaagaaaactacagaccaatatctctgatgaaaatagatgcaaaaatcctcaacaaaatacaagctaacataatccaacagcatatcaaaaagatcatacatggtgataaattgggtttcatgccagggatgcaaggatgatttaatacacacaagtcaataaatgtgatagatcacataaacagatttgaaaacaaaaatcatatgatctcaatagatgcagaaaaagcatttgacaaaatccatcatcgcttttttattaaaaccctcagcaaacttgacatacaaagatcataacttaaggtaataaaaaccatctatgacaaacccacagccgaccttatactgaacggggaaaagttcaaagcataccccctgagaactggaacaagataaggatgcccactctcaccacttctattcaacatagtactggaaatcctagccagagcaatcagacaaatcagtaaataggaagtcaaactgtcactgttcaccaatgatatgactgtatacctagaaaaccataaatacttatccaaaaagctcctagatctgataaatgaattcagtaaagtttcaggatacaaaatcaatgtacacaaatctgtagcactgccatatactaacagtgaccaagctgagaattaaatcaagaactcaaccccttttatagtagctgcaaaaaaataaaatacttaggaatatacctaaccaaggaggtttactgggggaaccagcccccaatatttcaaagtatgttcttttctattttccctaagtgtgggccagtctgagaaataaagagaaagagtacaaaagagagaaatttacagctgggtctccgggggtgatatcacatgtcagcaggttccatgatgcccacctgagccgcaaaaccagcaagtttttattatggatttcaaaaggggtgggggtctatgaatagggaatgggtcacagggatcacatgcttcagagggcagtaaaagatcacaaggcagagggcaaaactagaatcactgatgaggttccacatcccgctgggcacacattgtcattgataaacatcttaacaggaaacagggttcgagagcagagaaccagtatgactagaatttgccaggctggaatttcctaatcctagcaagcctgagggcactgcaggagaccagggcatatttcatcccttatcttcaaccatgtaattcagacactcccagagtggccattttagagacctcccccgggaatgcattcttttcccagggctattccttgctgacaaaagaattcagcgatatttctcctatttgcttttgcaagaagagaaatatgactctgttctgcctggccctgcaggcagtcagaccttatggttatctcccttgttccctgaaaattgctgttatcctgttcttttcaaggtgcccagttttcatattgttcaaacacacatgctttacaaacaatttatgcagttaacgcaatcatcacagggtcctgaggtgacatacatcttcagcttacaaagatgacaggattaagagattaaagtaaagacaggcataggaagttataagagtattgattggggaagtgataaatgtccatgaaatcttcacaatttatgttcttccactgtggcttcagccggtccctccattcagggtccctgacttcccgcaatagaggttaaacacctgtacgaggaaaattaaaaacactgccgaaagaa

SEQ ID NO: 599 - DNA, 20001 bp, Homo sapiens
gtcttcccagggagtgtgtccatcatacagtaacttctgtagtcagctaagggggcccattatgtcagggtttctcattcttggcattattgacattttgggccagatattttttggttgggggagttgtcctgagcattgtaggatgtttagcaatatctctgatttctccagactagaaaatgcccactccccatccccacccactcccatctccattctgtgacaaccaaaaaagtctccagacattgtaaaatgcacctagggggagcaaaaccacccccaccatgagaattactgcattatgtgcttttgaagaaaagcaaaagggccccaaagatcttaaaatatgtacctctgtcacattagaccagagtttctaaactcaaaatgggaaatgtatgccactagaaataagttatgtctgctgggattcttcattatgtgattttggccttgggccttgagaccaaaataggctgggcatatatcctggtttggcattatttgaaagccagaaatccgatcaatcgctgcttttctgtccttttcttttcttcattttcttttattttctttctttcttcctttttctttttctctttcttctttctttctttctttctttctttctttctttctttctttctgtctgtttgcctgtctctgcttttcaaagtttctgttcaaactgatccaaataaaactaaaaccatatggccagagtgggggtatgatgcccatctattttccctcattccttttgaaataagcacaggagccaagcatgacaaatccctttgcaggaagatcatttttagcctggttgttttgtgttgtgttgtttgaataattgcttagaacattttgatacttcatggcattttcctcccaagaaaaaagttttcagattagtaatatttttcttcactaatctcagtcttagccactaaaccgcaaccaaagggtctagaataaagaaaaagaccctgttatttgttattttttaagcgaaaaggggattttgtgtatatgtcttaattgggctggataccctgcgactatcttattgaagtttgaaagctgggagtttccaggatatgtgctaaacttgatttgcctgtgtgtgtttttgttaggtaccagccaaaatattttatttatttgtttatttatgtaaagaatgagggatttctgcttaggcctccgtccaggggaattcatggttcaataaagactaacagccccagcaaggttacagctttcaccagttcgtttctccctgggttctttatcaaaaggaaacagaccttctgagaatgaacttccagtggatcattcctttttttatcaaaacatcttagcagagctaaaagatagtctagctggtttgggaggcagaaaaataaggataggctaagggtgaaaaagataagcttagtgggacttatcctcagaaaagacctggatttctgtgctgtcatgcaggcccacccctaacactgcagagcttccgtggggcttgaagagcattgcttgttgaatggatgtctaggtttatgggttatataccaggcccgcactgggcagcaaattccaagcaacaaaggcaaccatgtgttcatcaatagagttctgtttttttgagtgtttgtgaaacactggactctctaaagtgcagtgcctagatgactctgacactaaaaaaatacataccatcagtaacctaaatcaccaaaggcctcctgctcagagatgtctatgaaggtggcaaatacccaatgctggcagagcatcagattcacctggggagcttttcgatgctacagacattcaacttctccagttcctcttcatcagatctctaggggtaggggctcaagcataaaaatcagtgtgaggttggaagccaaggttacagaggctacttgaaagcagtagttacagaaggccacccaaccgtgtgttctatttggacacctgtgagtgacagaagcgcatgtcatgtgctgcccttggtgggacaccacgcagacaacaaacgggacctttcttctctagttctttttggatggtcaattgtcccaaactttccaactcattcatcttgttactctctataaaactctgagcacagtcagcctcccatttgtgcttaatcaattaaccaattaaggcagtagatactaataccttatttcattctccaggtccctagctcagccttctccttcagaacctaaataaatattcaaagaagtaacacatgtttgagatttctgagggatctcaaataacctatagggaaaaaagttttcataatgactcatataaaagctggggggcccagtctgaaggtgagcttttcaagagcagttgaggacattcaggaattaaaaggtccttctatgtaaacaaacattttatgtgaagaaaagtttaaaatcgcattgtagaggacccacttactactgaattagagaaatgacatattaagcaaggcatctttgacctagactaggaaagaattaaaggtgccatctagggctgacagcagagccagaggcatagcttcttaaaacgtgtaactctcagctccgctgcaatgcattctggcctcttgggttcatatctcatccccatggacaatttcttgatgctatcatgtagaacacatggggttctaggattcattactgggcaaactctacctctggcagagtccagtcaacagggcctatgcaagtgagcatctgagggggctcaactgcaaaatttaattgtaaaaatcatctcaaaggtcaaactgtagtcaaatgggtaagttgtggctctgccactaaataaccctgggtgactttgagtgaataaattaattaattaattcattcattcatttatgtacttataaagtagctgttacgtgccagaagtgtgtcaatcactggggatatagcagtaatcaaaacagagaaccccaagcccatgcctgctagggaaagagatgttaaacaaaacaccaaaatacatgtagaaatacaacttaagataagaattgagaaggagtggtgtaacacgggggtccctcctttagactgaagggtcagggaggacctgtcgaagtaattaaactgaaacttaaaggatgattaggaattagacaaaatggtatgggaagagggcttcagacattaataacagcaggtgtgtgggctggtgttcgagggaaagagtgtttagagaagtgggcatgggagttacaaatatggtacttgccccataatgatgaaaatgatggcccaagggatgcaaaccagacatgaagggaaatgaaagagggaggtgctgaaaaagaaaaaaagcgagtgagtacattggtggtctgaccaaggctgctgagattggagaacggtttcagcgagggacctcaagcctgtgcactttctcattggagaagttcttatttgaagtagcagtagcagtgatgtccagcgggtggcagctggagtggatggctgaggtagagtgtagaaaacatgtattggcaatgagggggtcccaggaaagagcccattcaatgggctctatgttgaatatgcccctgaatattcacatttctaagaagaatgaagactggtccaggtgctaaagtttttaatgaatgacaggaagtgaccaggaggcttgcagacaatctcctctcttccctgggagacccctccgatttttgctataggcaataacaatattcagttttcttaactctttcaacgtgatgaaaaacacactaggcttaaaatcagaagacctaggttcaagttctggcctggtgaccctctcgatgtgccccttttttttggacatgtcactctgagcctttaggtctgggtttcctcatctgtgatttatataaatgactctcgaagggtggtgggaagtgggacggggaagacatgcctccttagggaagtccaccagaatttcgagggcagtggttttcaacccaccttgcacatgagaatcacctggggaacttaaaaaaattataagccacccatgagattctgaatttggcctgggttggccaggttttggaattttttgaaaggtcccccagtgattctgatgggcagcttgggaaccactgctcaagggaaacataggtcatttgagatgatctccaacttacaccactagaatataagcctcgtttttctgttttgttcacagaaattacctgagtgcccagactagctgacacagcgtaggcattcaacaaattgtgtttgcattttactctgattataaagcagatcagagcaccatgccccagggacacgataaagtcaaaattgtcactgaatgtcctattcaactacttaattctttggtcaatcctggccatagaaatgtgggtgaccctgtagccccaagcagaattctaaaagattaagttagattcatttatatataatgaacctccttcagaatgttccacacatgtacgtacacgtggcctcaacctcacaaggggtctgcatccaggggatttattcattagacccctagggagatcatggccccttttcctctctgttcccattgcaccttgactcggttttgcccctcagcaatcaaagagtgtagagattgcctgtttaaaaatctccctatgatgcccctgtttacaagaaattccctgaagacagagagtcttctattttccttctaattccagcacttattgataatgacaatgataatgatgatgatgtccctggctctgaaccaatattttatcacttaatgaatacatttgaatactgtctgggacacactggggattttcctctgctgtatttcccttccagtagagaaagaaccaggattagaccacagagcccagtcagaaatttacttggtggctggtggtggggtcacttagatgctgatatttccctgggatgaaggtaagaaggaaggggtgaaaggaagcttggtggactctggctcatgaagactggctgatgggttcaggttattgcccttttcccagcctgtttcggggaggtcagggaacaaaagcaccatgatgactttggaaagaaggagaggtcttacagggtcagaggggtacattagctgcaaatttttccactatgtggcctcctagaaataactggagtacgggaattaaaaaactcagtcctcagccttcttctgaaccagctgagtgacactgggcaagccacttaaccactcaatggctaaaagttgtcgctgtaatcacagtgccatagtgcaaatcaaaactaggtaatacatgtaaaatctcttcacaataaaaccctttccatgctctgtgaagtgatatagatagcaaagcactgttcccattgtgttctggtcacttaggtgtcctggagtttgctgcatcagctatttgggcagggcccttgtgagcagccccaggtctagcatagagcctggaagtgagcattgttgcgtgggtttgcagcttatgttgcctataattttagctgtgaatggtgcttttgtctctcttgaaatcagataagagcctaagggaaacaagaactttccaagatactgtcatctatcctttccctccaccagctgtaaggtaataatcagaagttccttgaaaatgttgattttcctgctggacatctgctagaacactcccgcctgtgaacgcccaggacagatctgaggggggccctgaagggttgtgcatcatccacaatggcctttgccttttctatcctttgcaactatttctccacaccttcttttgcacaagactgtagcctctgtttctcttcattcatcatgataaaatccaaattgcccaatagctgctactgtgtaagaacagctcttccttcttcagagaaccttcctggaccacctagctttggagctagctgaactttgacctaccccctcctactcaaatcctgtaaagcatttcatgttccttccctaagttagaaagcttccttggagttttctcatgcctggcattctggagcaaaactatgttaatgatgctgtagtaattttcctagaatctgggtctgagaggcccagattttttttttatggcagtgggtgctaggatggggtatttcgtattttcagacttttcttccattgtcagtagaaaaaaagacatatttccttctgtccttgctgttgtaatcatttagatggctctgggtcttctataccaaattactatcgttttgttatagaatcaacttcgatgactgatcaagtcttcagccttgttttagacaaggccaggactaggataaggttagtgaagcacttgcttttgagcacagtatttaaggagatggccaaaaactcagtaaccaagataactagtattttaatgtgtcttttaaaaatagacactaatgcaaaaaaaatccatgatgagcaaaatatgataattttaaataaacctgaggtcaatattattgagttttctttttgctccaggctgcaatgtaacctggcatagcactggcctgggatatctatttctgataggtttccttcatcagggtcttttctgatttaccagactgcttcattttctctgtggatcacgtacctccagtgggagtttccctaagccacagcaccctcaaaagccttcaatgtgctcttctccttcctttacccgtgacttcatcctcatgtgcgtaacggcagcagccaacatttctcgccaatgtgccaggctctgagctaagatcttcacattcattgtcagctaacctcacaatgtgcacaggtaccaattcaacaggtcctggtattatcccggttttatgttttatagctgagaaagcttcagagcgatgctatcacagccataggtggcacagctagtgcacagcagagccaccctcacccacccctctgtattgctcctcacagtttcagtcctcagtcttttctttcttctcgccattcacgaatcccgtcagtattcactttccaggacctgtcgacgtttctctttaagagctttctgttggattagaagctccactgaaattcatcttgctgaaatgcaaagctagatgaaggaacctcagagagaaagcattgatccaaagcaattaattccctcaatttgccgaataggaaacggagtcctggaaaggtgatacgatttgccagccttccctgttgatgacgcggcaggatcacctgctctgccactctgcctttcccctccctttccaccagactccagctcctctccatacaggactgggacccccaaagtgtcctgcccacccgaagttttcctctcaggcctccggctgtgtgctttgttcccaaaattgctccaatttcctccccttcgagcccacttcctccctaacccccagacacaggcattgatctcttcttttgtgctaggggttttgctgatatttgtaggtggccctctgaaaaacataaacaaaactggacctgactcagaataaagtggtaaagctggagggaaaagggggatggggcccagcttcggagagaaaattacctccaaactttagactgctggttggcttccaagtacagtgtgtggggtggatcaccatcactaaaccaagcccaccttttaggggaaggggtattattcaaaacacctctttatcctgacctgccaggaccagttcccctcccccgtgccagctgtagttacagccctctgagtcaacaaaggggttgggcttgtaagacttcatttataagcacctaaattccctttcacttactcccagaagctcattaatagatcagttggtcaacatcttggaatgtgccttggaaaaggataggatagatgaaaggaaagtttccatgagaggagaggaatttaaggccaaagagtagcctgaaatgtcccaagctctcattagagattggcaggctcagttgttgcattgctacacatggttcctaaattccaccaacagagaaaggtagtcagaggtttacccaaaaagactgtctgctggtcatgttactgcttatgctggcaaatgattaataagttgggaagaaaaaaacccaaaagatttgttataaaacattctgtggaaacttggggcagagattgcacccaaaaaatcagcgatttcaagttaatggtgatcaggtaaaggagatattttgaagtaatgtgatgcaaagctactaccactgattacagagtttgacatcactgctccaaggtaggaaacaggagatcagtaggaattctttaccttccttccacttttcaaatggaggcgaagaattagcttctatgaatcctttagcaactcatagcaagaaagagcttttctccttgtcctggtccaaattagccacaggctggagttattgagaggaacagcacattgaagttgcacagaaagttgttttcagggaggacagaaaaaaatggaaactgaattgggcagaccatgtgcctccctaaatccaaaattaaatccacgatacataatctgcctgccttctcacattgcactgtgctgggtggccaaacataccaaggggctcctgctgaactggaagcgggctgtcatcttagcctccatgaaaagctcatctttgaaaactcatctttccttacgggactactacattttacaaggattttttttcttctaaatgcaatacattgatgtttactttttaaacaaaaatgctcattattgaatttttttagttgattctacttttgcagtttgtgtaattgacatcctaggtgacatggagattcctgtggctgcctgactccaggcagtggctcccagaagctagcaagcagagcacactgcccagagttgggatatcaataccctttgtgaaaaccacaaaataggcaatttgaaaagtagagagaactctgaagaggaaaaaaggtcccttgccattttactactttcagcattttaattaaaatgtatttttgtcaatgcaatggttgtttcagacattttaagaaaacatcttgattccaaaccccggggtaaattaagtcaataaacttttgaagacttgtgccatgctgcagatggactttaaaagccactggggggtggggagaatgggggtttctaaatataataaacttcccaaaaaggcaatttcaagcctaactgaagtcatactatttttgaaagtggaaatcccccttttcaccacacaaccccgtggtcgagccatctaagaattcagcttctgtgccagtgataggacaaagctcatcctctgccgaatgccacagtcactcctcttccttcctgccacccacagggtcagcaacaagcactatcagttaaacgtgacacctggtgtctgcgggctgcctccggtgggagccaaatcccacgtgttggtgtggttcccacttaaatagatgttttcctttgaatcgtttcttttcaaccttgatttcagttctgtgctagtttctggacttttgccagcacttcttcataaaacagcttgtatttgctttgaaaaacaagaaaggtttgcattttggaaaatatacttcatacttcatacttctaacctttaccatggcctgaaggaaaaatgtagcagtttctttctgtaaattttaaatataggaaagatagcggtcactttataaagaaagccaaacttgtccacatccttacactcttcctcaaagttcatttccacattcaatttgggtcgggctttgtttagagtgccaatgagcctgcctgggccacttctgcattcttgatgtttgcagcattcactgcagaaactggcattaagacaggcctctgccacccacagcaatgctcctgccacctccctccactgtgcagccccaaagtgacagaggctgaggatccccagcaaagcaaactgcttctgtcatctgctttcaggcaattttgaggcaccttttcttggcttatttccactgctaagccctgacacaatataatatttcaaaagcccctaagtgctgacagaatactcaaaatcacattttacaaaaccaaagacagaggcctcccgctgcttattaatgcccatcatgataattccttactttgtcatagtctatgtatttgtgttgttgttagtttgtgttgttgatttgttcagccaaggatcaagcaacagagtgcaagtgaggccacccagcgagggggagaaggtgcagcctctcaatctacagtgtacttctaaacattcactttttttctgattatataggtaattcacgtttacgtgagaaattttggggaaatttgcagaacattaagaaaaaaaaattattgctctagatcatctccccaaaattgcacctcaatattttgggaaatattcttctagcatttttttctatgcctttaaatattcatcaccaccaccccctgcccctctcctaccccactcctccagttgggatcatgttaaacatactgtttcataacagtatgtctagcacactgttatggtgtagtgtaattagttttctgtcatttaatttgatccatcttttgtttcatttgttattataaaaacccagagtaatagccagagcagatgttattagccccatttcacagattaagaaaatgatcacacctgtaatctcagcactttgggaggccaaggcaggcagatcaagaggtcaagagatcgagatcatcctggccaacatggtgaaaccccatctctatcaaaaatacaaaaattagctgggcatggtggcacatgcctgtagtcccagctactcgggaggctgagacaagagaattgcttgaacttgggacgcagaggttgcagtgacccaagattgcaccactgcgctccagcctggcgacagactgtgactccatctcaaaaagaaaaaaagaaaaaaaagaaaatgagacacagaagtgcctatactaaagtcatagcatggttaagcttaggtctcccaactgccaataaagtgctctttgtctacatcaaattaaagggagagaaaagcacaatgtaggggtcctcaatattcctttgcaagaataagaggcattaatgataggtcattgacataatgactccttagagaagaaaaaaataatattttactactatagcaataatggcactgatttacaaatgacagaaaatacaatgttttcaggaatttaaaaatatttgggaaatgttggtgaatatatgaaattttcattcattgctggtgggagtgtaaattgacacaaccactttagaaaactggtaaaacataatgaacatcctaacacacagcattaccattccttggtatataacacacagcattacccaacacacagcattatcaatccttggtatatacctaagagcagagcaaggttcaacaaactatggtgtacaggtcaaatctggtctttgtaaatagcactttattgaaacacagctacatccatttgtttatgtcttctctagagctactttggcactgcaatggcataattgcgacagacagaaaccatatgacccgtagatcctaaaggatttactctttgaccttttacagtagaaatgtgccactctctctgcctgggaggataaatgcatatattcacaaagcagtatgttaaagaatgtttataacagttttacacacaattgccaaaaactgaaacccacccaaatgtctgtcaacagtagaacaaataaatcttggtatagttatacaatggaatactatacaatgatgacaaagaacaaactattgctttttttttttttttgagatggagtttcgctcttgttgcccaggctggagtgcagtggcgcaatctcagctcactgcaacctccatctcctcagttcaagcgatcccaaagtgctgtgattataggcgtgagccaccatgcccagcatttttttttttttttttttgagatggagtctcactctgtcgcccgggctggagtgcagtggcacaatcttggctcactgccacctccacctcctgggttcaagtgattctcctgcctcagcctcctgagtagctgggattacaggcacccgccactacacccatctaattttttgcatttttagtagagattgggtttcaccatgttggccaggctggtcttgaactcctgacctcatgattcgccctcctcggcctccgaaagtgctgggattacaggtatgagccaccatgcccggccaaactatggctatctacaaaagtgatatatttcacaaacataatgttatacaaagagtacttacaaaacgattccatttatataaagtctaaagaccagtcaaaaattaacatatggtgatccaaattagaatattggctaccttagggtggttattgactgaaaggaggcatgagagagaggcttctggggtgctggcagtgttaatctgggaggtaaatagggcatgtttattttaaaatccaacaaactctatactaaaaagtacgttatacctcaaaagaaatttagaaaacttgtgaagtatgagaaatggtcagaagagatggtaaaggaatacagaaaaatctatcgtaatgttgtcagatgtaattattaccactatatgattatagacgtctctgattggacagaataatgtaatagcatttttgttagcaaaattaatgccacaattgaatgctataacagaagttcacactaacaagagataagtctgttgccctcataagggttcttcactgaacaatatgaaggacttaaaggagttggcaaaatctttaggctctgaagctgccagaagattctgagggtaggcagatgagtagaaaaaagctccaaggagacaagagaggggaccagataaggaggagattcagtgattccactcaagctactcttattgcaggtggactctgtatggattgatgaccgatttcatgggaaaaaaaaggaagtagcttgccaaaagtctctggactctgtgaccgtgcctgattgaccaaaagtaagactatctttttgataattgacagatcaacacaccctcctagatgttacagacacagatcccattaactgaataaataaatgaagaaaatatgcagaaaggaaactgttaaccttggaagggaaaggagcagtctccatccactcttctttcacttacatctttatatttgtattcaatcactttgttatttttacttatttatgtttataccggctgtttcctctgcctggaaccttattcgcctgtgcatcctcatagctactccctatttccttcaagtcttagctcagatttcactttctcagtccagacctatacagactccctatctgaagttgctgcccacacactcatatcaatattacaggttttccctggcctgctgtgttttttccatcgtacgtatcacttccttatactctatgcactgtacttatttattatggctattgtctgtctgtcccgcaataaatgtgaactccacaggagcagagatttattttacagatgtaagtctgtatccctggcacaaagtaggcgtgcagtaaatatttgtttcatgaataagtgaatgaagatggtagtcaccatcctttctggcactaatatttagaattactgtggcccacagagtctttccaaaaagattgcaataatttgtactcccaactaccaatatatgagcctgcttattttcccatattcttattagtattacatattatcagtctttttcattgtgcactatttgttgggtgcaaatgtacctcattgttttttaaatttcatatgtttattaatcatttgcatgttcacttctaggaattgcctgtttatgtcatttggccacttttattttggattgtcttttgtttatcttgaggggctgttttataaattgccaatactttgtctatcagatgtagtctaaatactttgttccactgtcttttaaacatgtgacttgaagcatttagacatgtttctgttcaaagaaatgtaagaatatgaattttcccttttattattcagaagacataaaaggtgtttctttatgatgcttttttgcagtaaaggactattttcaagggttaaggctcctaatcaaattgcagctgtacttagtagcaagttgtgtacaaaatcctacctttcaggaacaaggaaaaagaaagataattgctaggctaggtttaaataatttgacttatagcagaattctttataagtcagtgataagtaacaaagtttatttttctttttctttggttttagtaaaacaaaaaacccaattggtccccagggtaatcaagccatgattctgtgagcaaagaataatgatttcataaaataatatattccatttatataacaatttatagttttccaagtacttttataaatattatcatatttgatcctcaaaaacaaaaccgtttctcagaaggtaaaccagaagttcataaaagctaactctggtgactgggattccatgttgattctgtgacagagccaggccccctgccttctatggaggatttctattacttaactaaattatttagattttcaataaacaaaaatgttaaagtaagaaaatgatattagagtattaagttgaacaggttaggccttaaaatgtatttattctttttgttctaataaaaatgttaagatcatatctatctcctcctgtcttacaaaagcagacagacatctatctacctgtagtttattcttgccccaggtcagtgctgacaattcatagaatacaagtcagcagggtcgagagaggcttctcgcaaatatttctctgtgattttagtgtctgtgatctgtatgtgggctacagtacaagattttaaagtagggatcatttatacaatctgaaacactttgggctcacctatctttattaaccaagcttaattccagatctgcccatgtgttcctgactcagctggcccctgccattcttaattaatcccgttcagtcctggtatatttaatcttttatgccacctgtttccaaatactctgtcaaggcctggctgggttactgctccattcaagccttcctattttggcttctcaattctggattgctgtgtttcagagtttcgtttcactgagtcatgaactgggcagcacctccaactttcctcttatttcaaataattctggccttgagcacttccttgctatttagcctgaggcatgagaagaccttggtctgccaaataagagagctggccagcaaggctgagtatcaacctcagtctggaaaccaacttgcctcagcattgcctcgttccaatgagcaaagagcctcaggaggtctggggaaaaggttcagagaactgtggtgtttttctcgtgccagatgtgatgataggactttggcttgagaccacatgtggagcttattcactcaaacttgttatagaatatctacttttcttccagtaatgccctgccaacaaaataaaaataaacacatgcagaggtagccttcaggtgcctatagttactttctattaaaacaggcttcttcttgcataacctgtttttcttctggaggaaattttttaagccattatttcttttcttaattttatttttatttttatttttaaatagagatggggtctcgttatattgcccaagctggtctcaaactcctggcctcaagtgatcctcccacctagacctcccaaagagctgggattacaagcataagccaccacctctgttcataacccatatatttctgaactatagcttaactcaatacaaccacagcagaaatgttgggggagtggggtagcaagaatgttgaaaataatactgtagtctaaacatcaacttcatagcttatagcattacagctttcttcaaactagatcactgtcatctgtaaacagtaaacaagaccgtttagtcagaacttactgtcaaaagcaggagccctatctgtttaatttttttcacctaatatttgcctaggacttagagatattatgtgatgacattattcaaatattcagtcctaggaccttagactttgtcaatttgatgaacagacttcttatattaggcaaaaaaaatgaaatttatgcttttttctctccttacaaaataattccctcccaatgtcctttttttctcagctttattgaggtgcaattgacaaataaaaattgcatatgtttacagtgtacatgatgttttgatatatgtatacattgtgaagtggctatcactatcaagctaattaacatatccaacatcttgcatagttaactatttgtgtctatgtgacaagcatgtataagatctactctctaagcaaatgtcaagtatacattacattattattacctatagctgtcatgctgtatagtagatccccagaatttattcatcctgccagagactttgtagcctttgaacaatacctcctccttccaccatcccctggcaaccaccattctactctctgagtttgacttttttagataaatacatgaaattatacagtatttgtctttctgtgcctggcctatttctttcagcataatgtcctccaggttcatccatgttaccacaaataacaggattccctttgtttgaggggctaaataatattcctctgtgtgtgtgtgtgtgtgtgtgtgtgtgtgtgtgtgtgtgtgtcacattttctttatccattcattcaccaatgaacgcttacattaattccatatcttggctattgtgaataatgatgcaatgaatatgggagaacaaatacctcttcaatatactgatttcatttcctttggaggtgtactcagaagtgggattgctggatcacatgatacttctatatttaatttttctaggaacctccataatggctataccaatttacgatttatgttcccatcaacagtgtaccagagttcttctccacatcctcgccaacacttgttatattttgtctttatgataatggtcattttaacatgtgtaaggtgagatttccttgggattttggtttgcatttccctgatgattagtaatgttgagcttttttttattacatatgttggacatttgtatgtctccttttgagaaatgtctattaagttcctttgcctatgttttaattgggttatttgtgttcttgttattgagttgattgagttcattttgtattttggatattaacccaaaaccatataaattatttgcaaatattttctcccatttttgtgggttttctcttctctctgttgattatgttcttcattgtgcagaagctttttagtctggtgcaattgcatttgtctgtttttgcttgtgttgcctatacttttggggtcatattcaaataatcatagcccagcccaccaatgtcaagaagcttttttcctgtgttttattctagtagttttacaatttcagctctcatgtgtaaatctttaatccattttgagataaatgcctaattttattcttctccatgtggacatctagttttcccaacaccatttattgaagagactgtcatttgcctattgtgtgtttttggacctttgttgaagatcattgaccataaatgcgtggatttgtttctgggctctattctgttccacgaacctatatgcctgtttttgtgccaatactatactcttttgattacaatagctttgtagtatattttgaaatgaggtaatgtgatgcctctagatttgttctttttgctgaagactgttttggctatttgtggtcttttgtggttccatatgaaatttaggattttttttctatttctgtgataaacatcattggaattttaatagagattacattgaatctatagatcactttgggtagtatggacatttaaacaatattcattctttcaatccatgaacacaggatatctccaatttttttcttcaatttctttcatagacattttgtagttttcaatatacaaatcttttatctctttggttaaattcatttctaaatatttttatgctattgtaaacggtattgttttctagatttttttggatgttcattgttagtagcagaaatgctgatttttgtatgttgattttgtgtcctacaaccttaccaaatttatttattgtaacagtttttgggatttttttttttggtgtaatcattgaaattttctatatataagatcatgtgatctgttttctatatataagatcatgtgatcatgtgattttactttttcctttatgatttgaagttttctatttctttttcttgcctaatagctctggctaggacttctaatgctaccttgaatagaagtgttgacaataagtatccttatcttattcctaatcttagaggaaaagctttcaaattttcaccaaagagtgtgatgttatctgtggacttgtcatgtatggcatttattatgttcaatatctacattgttaagagttttaatcatgaaaggatgttgaatttggtcaaatgtgggttttttgcatctatagagatgactatattatttttattataaaaatgctatttttattattcaatctgttaatgtggtgtatcgcatatattgatttgtgtatgttgagccatccttgtatctttggaataaatcacacttgatcatggtgtatgatcttttaatatgctgttgaatatggcttgctagtatcttattgaggatttttacatcattgttcatcctggcttataatttttttcttgtgatgtctttttccagctttagtatcagggtaatgctgacttggtaaagttagttagatgtgttccctcctctttaattttttggaggagtttgagaaggattggcattaattcttctttaagaagaattctttggtagaattcaccagtgaagacatcaggtcctggatttttcttcactaaaaggttttcaaatacagattcaatctccttacttgttttttgtctgtacagcttttctatttactcataatttagtattggtaaattgtatgtttctgggaatatatccattttttctagattatccaattgttggcatataattattaatagtaatctcttatgattctttgtatttctgtgatatcattgtaatatctatctcctttttatgtaaaatttaatttacttgaattttctttctcttttcaattaattcaactagtttctcaattttgtttattatttccaaaaaccaactctaagtatctttgaatttttctcttggttttctagcctctatttcacttacttctgctctagtctttattattttcttctttctgctgactttggacttagtttgttctcctttttctagttccttgaagtgtaagtttagattatttgagatatgtttcttcctttatgtaggcatttattactataaacttctctcttcagctctttctgtttctgttggtatgttgtgtttccattttcatttgtctcaagattttaaaaaatattttcttggacccatttgttgctcaggagtatgctgttcaattttcatatatttgtggattttccaattttcttcctataattgagttctagtttcatactattgtagttagaaaatatatctgataagattttaattttcttagatttgttttctggcctaacatataatttatcctagagactgttctatgtgcacttgaacgtgtattctaccgctgttgggtggaatgttctgtacatgtatattaggtctatttggcctataacattcttcaagtctgctgttttctttttgattttctgtctggatgatctatccatagttgaaagtcaggtactgaagtcccatactattattttattgttgtctatttttcctttcagttcttttagtacttgctt

SEQ ID NO: 600 - DNA, 20001 bp, Homo sapiens
caaagtactgggattacaggtgtgagccaccttgcctgacccctgatgtaagttttttaaatagctttctctcatttgtgaagtgcttcttcctctcttttgccctgtttttcattggctatttcaccttttctccattgatcttaaagtatagaaagctttatattaactctgttttgtagtgccaaggtacaggctctgcctctaaagcttacagcaaagtggcctgatctccacggcagtcagatgggttgtataaatggaaaatgtaaagcagaagcaaaggacatctaaagggtcaacacttacagtcgctctaatctcagaaggtctccaaaggtctctggctgtagcatttctagttggttgaaatgaatatacctggaaggcaaaaaatcaagttggttactccttgtgctggtgagtaaaataaaatgtttgaagaattagcaattgcttcagctgaaattatgaatttcactggccccaaccactatatatcacatacaaaaatcagaaactctgagatattttgtctcttctgttcgtcacagtcccgggtctaaaaacctgatgttccaaaggggaatccaaagcccacccagaaaggagcatgatgctgcccccttttcccagggagcctcttgagtcgatgctaactggttgttgaaattactcttttattcattaaaatgtttaaagtaagcaaagttacggtaataattaagattacaaacataataagatacattacaagtgaccacatgcttatttacatttcagaacagggagaagtgtcctgtctgacggagtcaaagtatggcatatttgatgtcatatgatcatcatacttgaaatgaattaatcttaaccctgggggatggatgagaagtaatgtgtcttgttttaatccttttggaattaggaattagactttttcagaccttggtatcccctctgtgcaactgatccaggagttatttcctaagcttccatttcagaaaggcttctcttaaagcagggcaactgaagacagaaaggcttgcatttccttcagaaatcctgtgatgaaatggagaagcatgtttccaaagcagacagttgagcagacctttgtgaagcaaatcttcccaacagacagaaagatccatggggaaggctgcacactcctcttagaaaatttaagtgtattccctgcacctgacttctgaacacagctttttcaaacaatctcagtgaaaccaacagtgatatatagcagtctatagtgaactgctgaagaaagcactgcagatacaaagtttccatgaaaagtaacaaactttcacaccaaattggaaaagaggatattgtacatttatgtgggaagacacagtgaatagtacttgattttgtcaatgggaagctctctgacttgaagtaatggcaggcaagtaaaaagaaagctttacaacccacgtttccataaaatgtatttatttcatcacagttagaaatatttttgaaaggagaaaagaaaaatgtttaagaaaaagaaatacttttacttcattcctaggcttccttcttataaatcattattatagtaagagtacttcagacacctaatgaaaaagtataataatcacaagagaatgaaaaccatgtcactggaaaggtatgattgtttcagactgccttaggttggatccagaagcagtgccacactgtactactctctgaaattcagcatcctggcccgtatcccatgcattcctcccaggagttctgttcattttaaaagtggtgacattttaccgtggtgacattgtataagacctggcaataattgcctttgggttagcatgaaacaactttaccttggttgccttgaattatacacacactcacactcactaacagactctcacacacacagacactctcagcttcacacatactttcatactgacacacactctcacattgtctcacactgacacactctgacacacctacatgaacacactctcacatgctcagactccctcatacccacacatgctcacactcacacacttacatatactcatatgcactaccacacttacactaacacacacacggacactcgtgcacactcacacttgttcacatacactctcacatacactaacacacagcatcacactcagatacacatctacacactcacacacactcacctaatctcacacactcacactgtcatgctcacactcacactgtctcatgtacactaacacactttcacgcactgacacatgtattcacatatatgctcacatacactaacacagtcacacacacatactcccacacactcacacactgtcccccacaaaatcattacctgtgtcattggtctagcacattaaaaaggaggtaggggctgggagagtgaaagaggatgtgggggaggagtgttaggcagagactggctgctgaaagcagggaagagagagaagtctctgtgactgcagtgaagaaagagttagaaggagggtccattacaaggtttctcttcccaagtgaaatgtatcgcatggttggattccaatctctgtgtatactggacaggcccaggcctgtagagtacaaatagacattttatgaagactaggaataagtgctgatgagggcatcaaacttagcataaagtaaataagagcaacagcaaaaaaaaatttattgtcctaagtgctttacatgtatttagtcatttttaatttttgcaactacactgtgtggtaggttctataaatacaccattatttacttaggaaaaatgtggtacagagataaagtaatttgttcaatttcacacagccagcctctctagcagcaagtggggggcggccgtgcacaggctcagctgacacagatcacccagagatgagctatggaaacctgatccaagaatcccggagcagagcctttcttgggtatggaaacagatactccacagggagaaggaaagtgcccaaagccacaaagccaatcaatggtaaatccaagccacaaacccagcaaaacccatgctctctacactcctgttctcagtttgcctacattagtggctttttaaatgtgaagctgtggggttcttaactggaggcaagcatcacattccagtcataaaacaacctaacaggtcacaggaaaggagtcacgagccgggtctgtggtttagccaacctaacaactcccagattttcaaagggagtattctagcttatgtataagcccagtagaagtgtttttttttttcctttcaactttttaatgctttgaaacaatttattataaagaaaacttgagtttagcataagaatttttaagtagcactagtattcctgccatcattgatcaaatgtgcatcctccatagtttgcacaggtgtctgcattgctagaagtagaaagacagctttcgcttgggagggcatcttatatactgagccacctaaaattagagcaaagagacaatctaaggggtagaataacatacaacagtttatccaatatcacttagctactatgtgttttattatccacagtaattaataattatcgatttaatatttaaatatttcacaggtagcaattcatatttactatgaattgctcataattcatgagaaatgcataatctccttttccacaatgcacccactgagagcccactaatcacagagccctgtctattccccattccagccatgcttccctagaataaatcactgcaatcttagactcacccagagatgccctgaaggacaaatgttttctgctggacttcaatctaatacacagtagggtaagcaactggtattggaattcactactaatgaatgagaaaaatgcatgtaagtagactttgttccttgcaggaaagtaagacaacccagagagttctgttgattatagtgcaagcatatttaagttttgtgtccatatgatttgacaaattttctaacaaaatctttttcaaaattttttttaaaactttaagccaatttaaagcagtaggatgttttaggttatatgtgtttgatttatgtgatggctttagcagattcaaataaggagggagtcagctttgatctccactcccttctgtgccttgataagagagcaagactatcctctcctacatcttatttttctaggctgtggataaccctgccatttttggatatctattgcaggtagataaatatgaatgattacttgagaggattttaaatctgtttaagtcacttcataaagtttatatgtaaatgaattactagttatccctttatttaaagcaggcaggaaattattgccattgtcatgtcatgttgattcatacttagcttccccagatgatttcatcaacatccatggcttcaattattatctctatgcagaagacctacaaattacatatccaacccaaatttacctctaggacctaaattcatgcacccaatgtcttcttaaaatatcatctagatgtctcaaggaacctcaaatccaacatgtctgaaacccagcccaggaatcctccttcaccatactggctgtcctccatttttgcttgtctcaatttatggcactgctgtatatctatttgcgcaactcagaaaactagcaatgacccctctgtctccctcactccctgtatcttacccaattctgcgttttttattttgcctcctaaatatctcttgaatgtattccattctcctcttacccactacttccacactagagcaaactataccctcggttactaaaatacaagaacaaactggtctgcctacatctatctggtctaccctcaatagaaatataagacccttaaatggcttttaatttctatagaaataaagacagaattttttcaacagagcccaagttccagcctggtcttgcctgtaaatgcccttccagtatcccctttatccccttcttgctctacctcaatcccagtgctctggcctcctcccagccacatacctgccatactcctgcctacagcagtctctgaatgattgtctttgtagcccagtaaaccttcccacccttcttgcctggtaattctggacctgttttcagatcttactgtgctctttccttggaaagccttccctgagctcctggtcaaatccccctgttatgggctcacccagcattgtactgttgcaatgtaatatttgagtgattatgtaatccatgcctgtctgccctaacgaaactctaagatccatgaagacagaaattatattggatttaaagtaatattcacatccctagtttcttagcagagtttgacaaatagatagtcagtacatagttgatcactgaaagaatgaatgaccagccagtatttttgcatgagcattgtctttgcaaacgtgaggataagacattgaacttttcatatgttctatggtataaagcaaaagatgggagtatgaatcctaataaaagctttctgagttaatatcagctcaacaatctataatggcattacatttccttggggaagaaccatcccaaacatttacacaagtctgactttagtaagctctgtcataatgtatgtttaattgtatctcctaaaactttgtagaatccttgagcactaatgaacctagagggcatctagcaaagtcttcctggggcttctccaagagaatccatctcactccaaagggacatgtttgaatcacacatttttgtgagcactgacaacacatttgacatctcgtatctgagtaaatatttatttacacaaccaccccgaggtatcaggccaccaaagagaggacaaaaatcttcctatgatctttaaaacatgcagagcaagaacatgtggtcagagaatgacaacaaaaataatagagagagaatgattctcagtgtgagaagttgctggtatcgctggtatcgctttagctttcagcgtgaactcactgagccacataaaaacaaatgttctgtgccgtatgatcaccttggcaaccccgatctaaggcaagagcagagatggggagaaaaacactatatttatctgtatctaactgcacaatcaaaatagcatatacggtcaatgttctcaacctttttgtacaaagtggctgctttttattttctcaaaatccatgagattgtaaagaaaaaaggagtactgttggcagaaggaggctgcacaccagagtgtctctgtgtctctgtgtgtctgtgtatgtaattttgcatgtgtctatatgtgtgtaacataagctaaggacatctgaatctgaagcttgcaatacaggggatcttgaatataagatgtcaacaatcctagcacatgaaacagagctcagaggaaaagcagtttgctgacagctggcttggagatccaccatgtcctgcctcacatccacaggctgggtgcattgagatgacacaaactttctgtataataatctcagctaagattaaaataggcacgctttagcttcattgcacaatagcaagcaagaattatctattacaccaacaaattattcatactattcaggaattaattaaacatctgaatgaagatccttatttcagagcacggtaaattatttcaactgattttaaaggaaaaattgactgaattatcataatctgttagtttccagagaaaagctttccagcatctcatttgcatgctgtgctaaagtcaataacagtgtattctaccaaaattcattataaagagaattatatttattcttaaagagttaaaaccagttaaaaatcatactgcacaagcttcactctttgggaagttatttcaatcctaaattagaatagttacagaaaaaggctgggcacagtggctcacgcctataatcccagcactttgggaggccaaggcgggcggatcacgagatcaggagattgagaccatcctggccaacatggtgaaaccccgtctctactaaaaatacaaaaattagctgggcatggtggcgcgtgcctgtaatcccagctactcgggaggctgaggcaggagaatcgcttgaaccagggattcggaggttgcagtgagccgagatcgcaccactgcactccagcctgggtgacagagtgagactctgtctcaaaaaaaaaaaaaaaaaaaaaaaaaaaactagttacagaaaaagtcatgtttctacaatagtttagatacagtatgattgagagttatgaaaaatctttctcactctttgttcaatctctacctctttttgcctgaactaatagctataaatgttccatgtaaatccagtctcttctttccaatctacactatgttgaattatttggtggttcttcctggaaaaatgcagattagaccatcccctttattaaggatcatcaatgtcttctcactgtctttagcaggaattcaaggcttttcaagattgagcgccaacctgtgactttcccctccctcataagtctgagcaccctctaaccaaattcattatctctggaaactctccgatttttttcatagtgtctaacagtcaaagtgttttctcacccatttaagatcaacagtacttttttttccattaaggacttagtgactgcttgtgtcagatgtaacttcattcctctggctcctttagtatattaaaacattaataagtacttattgagtgcccgtgaagtgtgagacaagatccttgaccgtctcagagactggaattaggtgagtggtcaaatacaaggaatcaatgaccacagtcttgtagaatacctattataataatgggatgcaaggaataccatgagaatccaaatatctacattagatttaaagataaagaaaggttatacaaagaaaaggattctctacctaacttttgtggacaaacagtactgacctagatgcaaaagagaaaagacagtgtagaaagtggggagacaaatgtatgtgaagtgcagagatatgaaaatgcaggactcttgcacagaacagtaaggagctgagcgggacagaagcactggttgcctgcagaactctgcaaagatggacttgggcaggaactgaatcacacatttcctttgtgctcaacaaggtgatttgaactttaccttaaagatataaggacacatgacaagattcaaagaaatgaaatttctaagtgaaatttttattttacaacattgccagcagctatgcaaacaaaggactggaagttagctagagagagactccagctagagcaatggtttgcagtggttttcagcttaggatgattttgttttgtccccctccatcctcccagggaatatctggcaatgtctggagatgcttttagttgtcgcagctggaagtggtggtgctactagcctccagtggggagggaccagggtgttgctcaacgtcctatcctacatgacctgggccagccccacaacattactaagcccaaaatgtcaacagtgccaggttgagaaacacctgagctacagcctgctttattttctgagcgggaaggagtggtggtgacgatgcctgccatgtggagcctcaattgaaggctgcaagagcttttccaaaggatcctagaaaaatgaaatgatagaaaactattaaaggggtgccaaataagaaggggaaagaattaatagaagcaaagtgaggaagaccctgcacaggaccaatggtactcgatggcaccaaaagggctattggaagatgttactgtaaaaaggaggcaggaatgtgtcccagtgaaacaggctggaataaaggaaatgggcactaactcacaatcgtctcttgtcacaaggaaagctagtgagaggtctattagctttgccctcaattttccccttaaggtaaaaggcaaagtcaactgtgaaatgtaagagaaatgtagaaaagaaaaacaaggctgtgaattttgaattgtggctatgtcatgcaggacaaggagctcagctccttttgatcattgctgctaaagctgggactgacttcttagtcctttccctagtggattttcagcagcattggaatgcgtcggttagtccctctccctgccatgttcttccctggcttccaggatgccatcctcccagatcttctcccacctcaatgggcctcctgctcagggcccttcactacttccttctctttccccagcctcctggactggagtgcctggggctgagtcctgaggcttctccctttttccagccaaactcaacagcatccagtaccaggaacatgagcactttcaggtgccaaagatacccacattgcacagccagccctcaccgccgccttacattggagacccatgccctactgccagccccatgcccatgtggctgcctagtagacaactcaaacttgttgtgtgcaaatctgcagtcctgattagtcttcatgcccacttcccagcatgtccatctcagctgaggaccacacttccttctagttgtttagggcaagaatctcagtaattccttttacttctttctttctccaacatcctacatctaagtggttggttgtaaaagagatccagatgctgcacccatcccaaacctaccctactgcctccttactctgaagccacaccacttctggcctagtgtacagcaaagcaaccaactggtcccccacccttgccaggccatagcctattgtctacgtagccatccttgttgagatagtagattttagatgctctcaccacacacacaaaacaataagtgtatgaggtaagacataggttaattagcttgacttggccatttcacaatgtatacatgtatctaagcatcatgtcgtacattataaatatatacaacatttatgtgtcaaatacatttttataaagaagaatgcaagaaacacagaaatcagagtgaccattataaggcctgttggatcaggcatgccaactgtccttcaaaaccctccagtgctcactcagaataaaatgtacatcgctcacaatgatacaaatcaaatctgttcctctgatctacacagttctgtgctaactgggcctgtctctctgctccagccacatcagcattcaagctgttgctctcacatgccaggctcactcctaacttagggtgttagcagcggctgcctttctgcctgcgctgtgcctccctggcatgcatgtgtctccttccctgaccaccaagcctttgctcaaatgccacccactcaatgagcccaactgtgacccttcctttttcaaattacaaccacattcccacgtcctggcacttctcaacccctccctcccctggttctgtgtgtacatatatatatacatatatacacacacacacacacacacacacacacacacaaatatatacacacacacgtatatgtatatatatacatatacgtgtgtgtgtgtatataccgatttaaatatttgccaaaaacttgcattatactatgcaatatgcttgttcatttattagttttaaagcttgccttccctgctagaatgttagcaggcccctcaaggtcagggattttatgttttgtttagtgccacagcccagatcctaaagagttttggcatgcaaaagacacccattaaaactgaaaaatgacaatattatctatattgcagggctgctgcaagatcagagataatgctctacagacccttagcacaaggttctagaaaggcagaaggccaagtcacctatgaaatgtagggggagtattggatctaaggcaagaaaggcacattgggaagagtccacagagccagcgagagaaggagttccattgtgctccttgtcattgctagaccatggtcaagttttagttttcacctttattgacccatcgagagcatgatcttactgagaaactcatctcacctagttctagaagatcacgctaagacttcctcttaccaaacatgagtttctggaaaaattgaattatttgaggatctacttgaaattcgagatgggtttgttgtgactcaaaatagtacagccttgtgattttgtggtttcctccaacacagtggagtagaaagcagaaataaagaaatagacactgaggttggctcatatttgaatctaaagcacagcaggggcataggacaaagcatacaagggaaaggaactataggccacatgcagagggacttaaatctggaaggcatggatagattttagatgagataaaaccgtcccatgagggcaggcctgagacatgacctaagaagcccaggagacctgaggctcatcgggtgatattttggaatttaagattcctggggccggccactatggttcacacctgtaatctcagcacttcgggaggccaaagcgggtggatcatctgaggtcaggagtttgtgaccagcttagccaacacaggaaaaaacattattgtgtttgcctgtgaacactgagatatgtaggggctggtctgtatttttttaagcactaattaaagggtttcaggctcaggaaattgatgttgtcagtgctgcaatttagggtcacaattcagtcaaaggtggtacaatggaacagatcaagggatgtgttagctatgaggatgctatcgtggtctaggaaagaagaaatgaggcagcgggtctcatgtgaagcagagataatcccaagagaaaatgcagaaatggattccagaggcttttacaggggcaggatggggcaagagaagcttgagcactggacacatgcaggcctgcactcatcttcttatttgacccctcaatcattctgtgatgctgtggctgatgatacttcatgccagggcagtggaagattgcagatcatctgtaaaaatcacctagcaccttcctgatacatagcagaagtccaaggcaactagagagaagaggaggttgagaaaatccttatggcttagaactttagacaggcgctagcagtatttggcctccttccctccagagttaatacagcatacaatagagcaatacaataatagaggggctggttgctgatggagaagtgactcccagtgcaggcctctttgtgaaacactggaatggacaacttggttggtgctgaggtcagcacggggactcttacttcctgcttccaaattaaaatcatcgggtccccttcccaagcttatgtacagagatatgcagggcctggagtatgtactccaaagccactcactgaccagttgcaaggagggggctgcaggccagactcaggcaggcagggcagaaaaaggatgactgaggtcaccgcagagccaccctgatccaggaacatcaatcaccaaccaatcaaatgcactcccccctttctagggagaagtgcccgagaagggggataaacgcccaggatgaagagtgcaatgctccctctcatgggtacagtaggcttgagaagaaatgtgagaaaaacacaagaaaagagaaggtaaagcccccttccccagtatactgtatctgctatatttcttgtcagccctgaacctgaatgcccccatcatccagccaagttactggctaaaagacttcagttgaatttttaaaagcaaaggaatggctgcctgctctgacatctccttcatgcaccatgattttatggcactgtggccgtgaacaatgctcgacagatcagaccgctccctctgaaaccattcccataaaaaaaaactcaagtgggcaggtgtgcacaatttatacacctactgacattttgaaaacggaacaagtatagggtatttcagagaagggcagcataatgtagaaatttcagaactcttgccatgaagaaaagagagcaacaaagttagatccaggggaggaaataaatgtgtgaagaggagcaaagactgagcctcctgagatgtgaggacaggggtaagaagtagacctgacatgacacggatggtgggatttctaagaagtgagagaagcacagagagaaatcagagaagaaggacctgatcacaaaggaggagatattccaatacgtccccctctcagccataaagtgaagatctctttggaagagtaatatagaaaaagggagatggcggcattgattctgtaacagggaaacagcaaatgaatgaatataacacactccatttttgtttaaggggtctttacccaatcctgcatgtaggctaggataactttagagcactgagataaaatgcagaaacagccacatgtagtttttgaagctaactctgggattaaaggggacatatgtaaacaactaatgatgttttgttgaagatttacaaaagcactatgacctcgccaaggacaaagtttccaaccttcttgaccctcgctggtgcccagatggctgcagtcacaatcacgtgactcttgatctcaattccctcctccccaccctgcttcccttaacataaaaaagagtctgaaatctatactgacttaagatggttacttaggacactagtctgccatcttctcaatttgctggctcttgaataaagctgcttttcctcccaccaacaggggcaagcagcccaacctaggttctgttccaattataaggcaaggaaggcatcctggaagggtctgtgcctgcatgctgtggaatgatccacctctccctctgcctcttgagttttcatacaaacaaaatcaattgtacataaccatcaggaagctaagatttgttcaaacaaaacaggactctagctagcagcagtgttgaagacctggttgcagaggggagatgaacaagtggtgggtggggtggaggagtcatgatgcaggctgatgcccacaggtgaggctgtgctgctctccagatgaggctgtgcacttgcaggcagggcctcggcataaacactctgaggatggaagcagtgaggaaagggaagtacaagaggtcagcactgacatgccctgcactgtgccttgtgaaagttgcttcagggccaccccgagcatgaaggtggtgggcccacatcttagtagcaggggaagatgagtcacactgtgcaagggaccagaagaagcctcagcttgcacaccaatgcaaccttactgcattctttttgtgacttcagacaagcatggcatttgattactacaacaacagaaacttttaaataagaaagagaatgaagctataatgaaagttacagaaaaattagcattggtcactgatgcacaatattgaaacattttctataaatatattttctcacaatagtgaaagagaacaacacactatagattagtattggcatgcatgcatgccttcctcctttattctaaattggctttagaaactcaaattcacttttgtaaatgcatctactgtaaaaagttatatttaagtttgctccacaagagtctaaccaactataaaattctacaatgttctaaatattctggcctggaagactctcccaattaaacccataaaaccagtttccagatgtagacgtagttgattgtcacctggggatttatacctcagagagaactagacacagctttaaccaaacctgaccataaatgaatattgtttctcctctatttccataacaatggttttattttacatttcacttctggatgtaagccatatacaaattagaggaggacattctgccatgaatagaaccccttacagttattgaagaagaacgcagagctctattcctcactgaggaagttggttgatgcttgaaatcctgagcatatttgcattgcattgagaataaatggcttttatctcagctggagccatgagaaataaactaatagtaggcttttaacatttagaggataatagggaagggaaagatactaggacaaaaccataatgatagttgtatgaaatagttaatgaataaaattgcaaaaaagactatattgtttcagtcagcaaacatatttccaaattgcaatccttatttctttccttttaaatcattaatttcagatgtaatagaaagtgtcaggttgctatatacggaaccatccctggatgaagctttccaaatgcaacatttaagacgcggggcagcagactcaatactatattatgaaaattcacatgttttgataattcaaatgtttatgatataattatctgtaatgcaccaatccttcaggtagcatcttccaatagtacaatctaaatgccttccaatacataggactgacaaaggaaggcagaatataaatcagttggtgctcctgaaccccctgttcaatactttgagcaaatgacaccacttaagtatgtccatgcccacatccactatgccactccacaaagtccaagcaactgagcaagaccgtctggggcttgatggaaatcccagagacataataaatacagccctggaaatgggagaaagttgcatccccacactgacctccagaaaccaaagtattgaagaaaagaggcatttgagacaagccaatgtccttttcatccccacaatcgttgctctgtgcaaaattcccatttcataacatacacattggagaaacatacttggagaaactttggtctgaagcatcatgacattgtcttaagcagagaaatacatagtaaagaataaagagaattagacctaaagttacactagatgcaaacagcagcgtgaagccaggaggaggctgcgtcctcgccagagcttagcctcaccttacaggggcgtgagaacctcagtgttgaagcccccaggtggatgcctgctgaggagggaagggggcaaggacagtgagggacaatcggggtgatatggaagcaccctggtcatggacttgcaggctcttcaggggctcagtggaagagagcttagatggaagagcagggggagatcatccacagacgatagggttccagggggcaggtcacaccctagctggtctgtgctgctgtgaggctccaggggtggaggcattgtcgagaggtggagaaggaacccactgtgaacacatacctgatagttctgggaagctgacttggaaacaaagtgcccggcatccatgttctccaggcactcttgacacacaccactaaacatgtacccaagcgcactgcggatgtttctttagatgtttctcttccctgtccatggcaaaagtccttgggagctgtgaggaaaacacattccttgccttcattttctcttcctcttgtcctccctcgtgaacatctcacgggattgatggactgtcagcctcctcccacaggggagagaataagctcttggcttgatttgtctgatctctggaaagtaatcagaactccctgagagctaatgttcttacttgtcacaagtggaaataacaatcttttggaagtttcatgggtgtgagtgaaatattctcatatatagacatacaaagcacaaagcacagactgtcacaataattgtgatcattttgatatcagatttctattagttttttcctctttcctaatttcatgttttacaagattttaaagtactcgtctggttcaagtttttatattaataaagatatatagtagtttttaaaaccctctaagtaactttataagcctctggggggtgaaatttcaatttcgagtcataactgaggtataagaagacatattttcaataataaaacaattgaaaggatatagcttcagctttgggtggatttttttctgtgtttctgacttttaaaggatattattaaagcctctgttgaaataaaattatgtaactttaaaaaacaaatatttacaaagatcattctgagatgagtaacaacatcctataatttaaatcaaagaaacatgttatatttcttctattcaatttatgtaaaatatgcatggtgaaaagcagagccctgattgtgaaaatatagcacagccacttttgattagaaacacaaattcaagtcaactctagaaagaagttaattttcacttgggctgtagagcagataaactggtatttaagcctgggcgtctgtgagtatcttggctttgacagacacaaattacagcctttccaagaatatactttcatttgtatttctccttcaaagtaagaggattgatagtcagaaaatccaccatgataagtaattagggtttgttgatggcgctttattttactttaaatcgacattctatcccagtatatttctagacgaaattagttttacaatattagcattttctagagagtgctatattattctcatctgccagaatgagatgagacatacaaagaaatgatataacttgcctcaagtcacacagtcctttctgttcttgccattggctacatcgtaaatcattccttggtagtaaaatgctgccagggcccctttaactgtttcctgacactagggaccaattaagatgtataaattatgcatttaatagatgctccctgcctaaaagagttaaaatgcctctgaggtcctacttcaacaccaaagcctgataaataaaagaattagaagctagcaagccatagagcttgacactattaattcctatttattattaaccccaattatcagaagttctaattatccaccttttatttcattttagcatgttctgtatattcttccttttactttcttttcaggaaaagtataaaacaaataagtagaacactagtaatgatttatttcaattcattgtaacctttcactacggatgctcagctctgattgaatattatatttgcccggataacttttttaaaaaatctagattttttagattttgtatcaagtatccaccctgagagattctgatttcattgggctgggtgatacccaggcagtgttatttttcagaaattctccaggtgattcttacacaaaactctaatagaaaaccattgttttatagcaatgaaatatagatgccatatcataatcaaaatatacgaaaatatattgaagtactttctgaagaaaatattagtgtatactgtgcaaagtgcttttactgtactcaagtttaaaaccaataataatggtatatataataatgctcagggtgctaaaatagtaatagaaccttttcctatccattgtagacacaattgactatgtcttgctcatgctttctaagacttggtctagcttctttgccagagcagtagatttgttatttctaaaatgccagtgcaaaataaaatgtatcatactagcattctatggcacatcaaagatgagtgataacactattatatgtgtaattgcctcttatatgttttatcaagggataattttatatgatcttgttctttttcctaactggtgacaagctttcaactagcttcagagggagagccgagattaattgcaatctagtacattgtaactgttgcttcctgtttgtgaagatcagcatctaatcaataaaatattaatgactatttttttagcccttctaaattaacagctaaaggcaaagagttgtttttgttctccactctatttctttatagttgggtgtaaaatcaaatgaaacgtacttttcggtgtgattaatgctgactttaacagattgcttctgtttggtgtagttagttccttaatttatcttcatataatagcaaggctgtgtctctaacaaacctctttaaggctactgtttcttcacagtgttcttcctaacgtcagggtcagtgtatcttgttttgtttttatcatagacttgtttaacatgttaatctttttgaagcacaaataaaaaggaaatggctaactctcatacctactgaataagaacttctgtgaggacttctgtaaacccacagacggattccaatgctgaatttccaactggcctataagagctcctggagctccatctgggcacatgtcactgattcttgggccaagactgccagagtccctgttctcaaggagcacacaatacttgggagaatcaagtgtttctatgcacatcaaacctatgcacattaaacaatcacagcataaaacatatgcatatatatatatacatatgcatacaagcatagaacatataatatgctcaaaactgtggaatacagctgagtgttttcattggtagagatcactatggactgaagttgtcaggtaagatgttaatgtaatcttgatttgtgtcctgagaaactcttacagaggcaggaacatgagaatgaggtcagtgatgggaaaatagcataaatcatagcagaaaataatgctaacctcactagaggattcactgcactgcagaaaaaggaggaggtgactgacaggttagattacactgcaccctgagaatgagagggagagaatctgatttcatcactgtaggagacatgcagcaattacatattaatgagaaagaaagtggctgaggatgagtctgacagagacacaaagaatgggctcgataggagaaatgatggtagcagaaaaacctgggaggtgataattgcagatgtcacctaatgaagagaggcacaagtgaaggaagaaggggtgggaggaaggaaataattaaaggctaatatgaaagacaaaagggacaggaaataaacaaggactccaggattttggtcagaaattttttaaaacagtagtggaaactttgggataggaaatggatttggccattaggaaagtgaaagtactgacataagatggatttttcttattttgagaatttgagaagaaatacaagtaaaaattgtcattggtagttttaattctgtgatggtaggataaaaaattaaagtaagataaaaatctagattggatatgtagaacaaaactaacatataaataatatctaagtacaagagtgatcaagaatttcctgaagaaggccgggtgcggtggctcacccctgtaatcccagaacttgggaggctgaggcaggcagatcacctaaggtcagaagttcaagaccagcctggccaacatgatgaaaccccatctctactaaaaattagcca

SEQ ID NO: 601 - DNA, 20001 bp, Homo sapiens
gttttggaataaaaaaatctgcaaaggagcctatctgtccagtaagcaccacagaaacagagttcccagtggcagccaccattccttgagggcctcccctgtgtctagcactttccagagttttctctctgattcctccactcagacctagtagggacaactgcagggcctgggctgcaatggtggggctgggctgcagtggtgggctgggctgcagtggtgtgtctgggctgcaatggtgggctgggctgcagtggtcgggctgagctacagtggtggggctggggtgcagtggtgggctgagctgcagtgggtgcagtggtgtgtctgggctgcagtgatgggcctcagctgcagtcgtgtgtctgggctgcagtggtttttctgggctgcagtggtgaggctgtgctgcggtgatggggctgggctagcgcttcacgtgtgggtctctcacgcctggtaaaccaaatgccctgcagcaaggagtccacacaggagcctgccaggggcggctgctgatggctccggcttctgcaccacttgcccggggatgtgggggctccgtataccctagtattgttaccagaaaggagtcccagtccaaaccccaagacagggttcttggatctcagctgagtatacttatactgatttctggattataggctcaacaacaggtggattgtttgtgagttttccaagaaaggggaggggatttttctgaactgagggtccctctcctttttagaccatatggggtaacttctggacgttgccatggcatttgtaaactgttgtggcacaggtgggagtgtcttttagcagctaatgtattataattagcgcataatgagcagtgaggacaactggaggttccttttgtcgccatcttggttttggtgggttttggctggcttctttactgcatcccatttgatcagcagggtcttggtgacttgtatcttgtgatactaatcctgccaacctcctatcttatcctgtgactaagaatgcctaaccccctgagaatgcagtgcagaaggttcagcctcattttacccagtccctattcaacatggagtcgctctagttcactcgcctctgacagtgatgatctatcctttactggggctcagccttcacccactgaggggccctggatggaagcatgtgtttgcttggtggggatgacaagtcgaatttcccagcccctgtgatccagaggctcttccaagacaccgggactggagaggagtggggggcctagatgggggtgggcacgagaggctggtgatggcttcaagaggggaggggcacacttgccaggaagaggctgagtgcagcagagagcagcgggactgacatttgaggcaagggtcctgtggagggaggagggaagaagttggagagtgatgcctggaggccaaggtggcaccactgggcccttccgcagctcctggggggaaactgggttgggcccaggtgagcaggagggaagggagggttcaccctgggagtgcaggatgggtgctggtttagggtgaggacctggggaagcaggagaggttaggagaacgaccacgctgaaagtgaaaccgcctttgcaaaaactctatcaattagaaaaattgtaagagtgagctgagctaacccgcccctcatctttcctttcccttaatgattcctgggcttttgggctgagctaaccttgggagacatttaatttatagtttaaataacagcaggcctcccccaaaactcttctgcctgtgtaaacctaatgaaaagctatgaggcgagagggagaagctaaggtgtagacctctctagcaaaatacacaatttccccaactgtagattggtcttttgagatatcttttcaggttttttgcaggtctgatacccatggctctacctggaacccccaacctcactcctgtgacacccccctaagaagcgatttagcctgcaggaggacagctttgaccctccatgagttcatgtctgccccagccaatcagtacctgttacttggccacccctgaccccccaaactgccttgagaaacccctagctatgagcctttgatgagatgatttgagtacaaactctctctaccatgtggttggcctcatgtctattaaactctttctttactggaatgcatggtctttatttagaaagggagcaggaggaaccccttgggtggttacagagggcaggatgaaatccctttgaaatgagcagtacagaactccaaaggaagagatggggtctgtgtgtttcttctgccacctgaaataattgaaaggttcaaaatccaatgttatagagtttattcgaactctaagtttgacgaccaccactcaaaaaacacagactctaaaggaatgggctcagtgctctgaggtggagggattagggcttcacttaaatgggaaaatacaaggaggtttagcatgattacattttccacataagattggcttatgagttgcagcaatttgtttggttatatcctgttcccttcgggaaaagtatatttaacatactgtcttatggaatttgataggcatggggtcttttgtaccatctggtctgagttgggtgcaagaaaagaaagaagttaattcgtaacaaaaggtcagtaactaagaaagggaaggggtcttacatctggtgccatttagtctttcataacattttacaaatcaagaaaggaagagcgttaatctataattggagaagcaaagttcacagcgacttgctgcttgactagggtgtcagaatcacattctttcaaggctcgaagtaatttaaagttccaacagctttaatctgatgagcttattgtcgacaaaaagagtcaaactctgaaaaatatttgaagagatttattctgagccgaatctgagtgaccaatggcccgagacagagacctcaggagggcctgagaacatgtgcccagggtgatctgggcacagcctaattgtatacattttagggagacatgagacatcaatcaaatacatgcaagatccacattgcttctgtccagaaaggtaggacaactcgaaggtggagcggggaggttccaggttataggtagattcaaaatttttttattggcaattggttgaaagagttattatcactagaaaggagtgtctaggttatgataaggggttgtggagaccaaagttttatcatgcaaaggaagactccaggtagcacgcttcagagagtatagattgtaaatgccactaatcagacttaaggtctgtgttaatgttcatgctggtcagctttgctgaattccaaaagggaggaggacataaatgaggcatgtccactccaccttctcttcacagcctgaaccggtttttcaggttaactttggagtgccctggccaagaggaggggtccattccgatggctgggggagtgggcttagaattttatctttggtttacactactttcaagctgcgaacatcataagccaccttctgccaggtgtggccctggggaggggtcccttaacatgtgataggaggtgccaccacggctaggcagctacttgtcatcaggacacagaagagcctcttggacctggggaaggacctgtgagactgtgaagaggaaaagtcagttttgaatcaaacccattttataaataagaaaaattacaaaacgcttctcagaaggcggcggggtggggggcggtgaggagggggacccagggcacctaaaggctaattcttgctagagtcatttaaattttaacttaaattttctaatgttgctaatagacttaattatctgttcacaccttttaaaaatggctaaacatggctgagcgtggtggctcatggcaaaatcccagcactttgggaggacgaggagggtggatcacttgaggatatgagtttgagaccagcctggccaacatggtgaaactccatctctactaaaaaatacaaaacttagtcaggtgtggtggcaggcacttgtaatcccaactactcaggaggctgaggcaggagaatcacttgaacctgggaggtggaggttgcagtgagcccacatttcacgactgcactccagcctgggtgacagagggagacccgtctcaaaaaataaaaaataaaaaaaggaatggctaaacataaacattacttttacaatcaaaaccatttcaaaggccttacttcactggattctcagccagtgctgcccccagagcagaaggcagctgtggcaagcagaggggcggccccacctccacctggaagattcctgctcagatcctgggtcacctgcccaactgatgatgccccagctgctcctgctgcgaagctgaacccagaacccactcaggtctggtccccactccgcccccagcacccctagtgcggccacgcgggaggatggggcccgaggctgcaggggaggaagcgggtggatcaaggcaagcctcgcctcgcctcgcctcacccatgggtgttggtttttgttttttaaaccaaacagagcagagaggggcaaggaagcaaaaatgactcaagcccacagaggcagcagctctccctgtgctgggcacatgcccaaggctggctttggggacaaagaataatcaaagatgacactttggggctgccctctccccagccctcctgggcaaagtcggtgcgtcccaggagtcagcctggacttgaacctctgacacccgattgctgctggcctggtgcagggacccgaggggcccgaggacacaggaaagggcctggagggagagagcagccggactccgcccaagcaatttaggcgcctgcctcatctgtggtcccccacacccccagctcaccaagcagcaggacaacccctggaaatcccccagggaggcggggcgcagggattgcagtgaggccctgtgcccaggctggctgtgccctacctgcgggaagagtcactccagtccctctgggctggtccaggtgcaaccacagtaggacacaggtcaactccagtgaaatgtggagggaggaagggtgtgcctgcctgctccttcccctcccttgcagggaggggcggttgccctcagcaacagaatgcccacgtgggatactggaagcttcagcttaccccaccccacccctccaggcccggtttgtcctgggcgcaaggggctacttcagagctgccaggcctccacagcaacacattaaatgttctggaaactaggagatgtggcactgctgtacaacggtcaggaatagccatcctgtcctcctgacccggtgaaaaccagcttctgctgggaaggagcatggggtggcgcctggcttttggagtcaggaagaaccaggcttaagtaatagaactgcctgacctccagcttgtctcttcagctcccaggtctgtgctcgatttgggattattgggtggggcacataagaagctgcgttctgtgctctcagggtgctggacgctgtttcaggtaccagtacacaccagagggaagagagtgcctgatggcatggtgattgattttagtggagacagctagacactaaaccaggagttctgtcatgccagttggtgataaattgatttcttgaagatttttccacttccaagcaaggtagaatagatgcacctgtccccacgccctacactaaggacagttaaaatctctgtatatttccctgggtattacacatacatatataactacatacataaacgtatgtatatcaaacactaaaaggtggagagaagaaggcagaccatgtagggaccttgggacctgaggaatgacatgacaggagttccctgggttttctttctgcctcatatatctgtgactgtgtgctggaaaagccagcaacacgaaacaccaaaagacacagacaaaaaccaacaacaacaaacccaacaagttggccctcagccaaaataattaggcaagaggaagaaataaaaggtatccaaattggaaaggaagaacttaaattgtccctgtttacagatgacatgatcttatagaaaaccctaaagattccaccaataagatgttagaataaatgaaatcagtaaagttgcaggatataaaattaacatacaacaatctgtagcatttctataccctaacaaagaaatcaagaaaacaatgtcatttacaatagctacaaaaaatacttgcaaataaatccaaccaaggaagtgaaagatctgtatgctgaaaactataaaacatttgtgaaagaaattgaagatacaaataattagaaagctgtcccatatctgagatcaggtgccaaaaaaaagacatcccatgttcatgaattggaagaattaatattgttaaaatgtccatacaaccccaaacaatctacagattcaatgcaatccctatcaaaatttcattgacatttttcactgaaataaataaaataatcctaaaattcgtatgagggagtaacacctgctccacagtggcacaaagcactgtcaggtgccacacacagcctgttgggacatgtgggccacagtacttccccacctaaagtactgtagaggcccaggagacatgagccagggccattttaactgtcagtaatggccacaaagacccctaaatagccaaagcaatcttaagcaaaaagaacaaagctggagacaatacactacctaacttcaagatatactataaagctataataatcaaaacatcatggtattggcataaaaacaaacagaccaatgaaacagaatagagagcccggaagtgaatccatgcatttacggtcaactgatttttgacagaaatgccaagaaacacaatgtggaaacgacagtctgttcaataaatgatgttggggccaggtgcagtggctcatgcttataatcctagcactttgggatgccgaggtggaaggaccacttgaggcctccctccaggctccggaagagacctcctccatgatcccttgtctaaggggaaggttcctcaggaccttaccgtgggggctgaaggtggccacccctccaggaacttatgccccaggcgctgaatttgggctgcctaagtctgtgtgcgtgagtctgtgtttgtgtgcatgtctgcatgtctgtgtgtttgcatgcatgtctgtgtgtctgtgtggtctatgtgtctgtgtgtacacttctgtatgtctttctctgtgcatttttgcatgtgtctccatgtgtctctgtgcatgtctgtgtgtctatatgtctgtgtctttgtatctgtgtatctgtgtctgtgtgtctttgcgtgtctggtgtatgtctgtgtgtgtgtgtatgtctgtgtatgtaacggtgtgtctctgtggcggggggtgtgtgtgtgattgtgtgtgtgtgtgtgtctgtgtatgtaatggtgtgtctctgtggcggggaggggctgtgtgtgtctttctgtgtatgtgtgtgtaacggtgtgtctctatggccgggagggggtatctgtgattgtgtgtctgtgtgtgtctgtgtatgtaatggtgtgtctctgtggcggggaggggctgtgtgtgattgtgtgtctgtgtgtgtctgtgtatgtaatggtgtgtctctgtggcggggagggtgtgtgtgtgattttgtgtctgtgtgtgtctttctgtgtgtgtctgtgtatgtaatggtgtgtctctgtggcggggaggggctgcgtgtgattgtgtgtctgtgtgtgtctttctgtgtatgtgtgtgtaatggtgtgtttctgtggccggaagggcgtatctgcgattgcgtgtctgtgtatgtaatggtgtgtctctgtggcggggagggtgtgtgtgtgattttgtgtctgtgtctttctgtgtgtgtctgtgtatgtaatggtgtctctgtggcggggagggtgtgtgtgtgattttgtgtctgtgtgtgtctttctgtgtgtgtctgtgtatgtaatggtgtctctgtggtggggagggggtgtgtgtgatttgaggtggggacggggcctaggcttcagttactcacaacaggacggacaaaggaaacagagtttacccgttctgctaaaaccaagggcgggagggggacggggctgccggcagccctcccagagcccctggcagccgctcacgggttccggaccgcctggtggttcttgggcaccgcagtgaacctcagcttcctcaggacggcgggccagcccagcagctgctggtcccacaagtactcgggggagagcaccttggtgggtttgtggcgcagcaggtacttgttcaggtggctctcgtcgtgccacacggcctcgatgccgttggcctggtcgaccatcatggcctggtggcaggccctggtgagccgctgcacctcttgcaccgaccccccgaagaacccccccaggtagtagaaatcgccctcgtccttggggatgtaggcctgggactggggccggcgctcgtaggtgaaggcctcccggctgcttccgtagaagccggggtgcagggtgccgaacagcggagtcaggatctccacgcccacgtggtcgcggaactccatgtccacgtccacgcacaccaggtaatccacctcgctgaggaagcgccgctcgcagaagtcactgatcatctccatgcggcgcatggacacgtcctgccagcgcttgtaggcgcgcacctccagcactgacagctgccgaccggtccccagcgtcacgcggggcaccgcggccggctggtcggtgaagacatagtagtggacacggtggcccaccatgaagtgcttctccgccgtctccaggaacagcttcaggaaagccacgtatctgcaaggcaggcggacgggggctgggggagccgccggccgtgcacccctgggctgcaggaggcccgtcctgcacccgcccgccagcggccattggaaggcttagagcagcagatgcaccacgttctcctgccctgtcctgagcgagtcctcgggctgcgattcacttcatcctcttcccagcgatgggggaccaccagcaccccctcttactaaggagggctgagggcaggtggctggaggctggtagcaggccgcaggctggcgtctgctcactccccctcagcctggcctgagccacgcctccccacgcagctgcccctcttatggccaggccggccacgtgctccctcattataagctgcacgcgaggcctccacacacccgcctctgcaccctagagcttcctccctccaggcttgaactgcacctattcctaagagtaagtcattcctggcctccgccactgtcgctggcccagctgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacctcactgacttacttcttgatggcaaacacagttaacccaatggtggtgttctggagcctgaactgctcgttgaggatgtcgatgttgaatgtgccctcccagacaatgggagccagccaaggggtaccacgaggacatccttcctactgcacatggagagaggcgtgcggtcacatggagctggcagggtgccacccacatgcgcctctggcacacggccgcccccacctggaaactccactcagcttctgcctcctctgaccacccttccagaggcagccgcccttccccgggaaaccaaccagaggcaaatgcgactccaaccgggcaaatcattcccagccctccctcaacattggacctgtgggaacacacagcaagctgagctttgctggcaaagagataggaacaaaccctccccagcacccaacccccgctgcccctccccaggtaggaggtacctatcaggcctttgcaggggctttggagaacaaagggacaggaaacaagagacgcaagtcagagaaagcaaagggaaagaggacagccatgtgggcctctgaattcagatgtcaggagaatctgagaggagagaacggggaagcagccccaactgagatttacatcaaggaaaccgccctctaataccttcagaacagccccttgagctgcgttcagtttcagtgtcagtaactttactcaccacggtgtcagcacctttgactgggggtagaccatcctgcaagcacaaagcgccgccacgtgagtttgcatggaaagcgtgggatgcaggtaagcagggggtgtgcacagccgctgaaccatgactgggcattgaccctcccgccaaggccacactcccaggctggaatcactgtggttgcttgggggctgtgtcagctcataatcccgggacctcgggaaagggccgaagctcagagtctctgattcagcacttataaactggcaagagggactaagtgacctcaggggccattgctttccacttgacttaaggctgggagggacgtaaggggttgtgtctcaattcactgtgggcagagaggaggctgggtgtgtggcctctgtccctggttgttcccagggaaaggccctgagatgtgcagacctccccacctgggcccgaagcctgctgggcctccttgtgggctgctggcttccagagcccggcttcctctctgagaagtgggagagtgacacctgctccacagtggcacaaagcactgtcaagtgtcacacgcagcctgtggggacgtgtgggccgcagtactgtccccacctaaaggattgtagaggctcaggagacatgagccggggccattttaactgtcagtaatggccacaatttgaatgtccaagatggcctttaaaagcagggagtcagcagaaaacaggaaggaaattctgacacttggtacaacctggatggaccgtgaggacatcacgctcagtgatttgagcccgacataaaaacacaggtaccattgactccacttataaaaggtagttggagtagcagactcataacaacagaccatggaatggtgagctgggggagggaaaatggagttgctattttatggggacagagcttcaggttggcaagatgaaaagagttctggagatggatggtggtgatggctgcacagcaatgtgaatggacttaacgctactgaacactccaaaatgactaagatggcaaattttatgttaagcgtatttcatcacaatttaaaaaaaatcaaaagcagtgtggccagcttggccttgattgcctaggtcagcactgataaaggcccacatcctgggaaacagccctccaaggccccagacagaacagaccagctggtcatcttctttaaaagccaatttgaaggccaggtgccggggctcatgcctgtaatcccagcactttgggaggctgaggcgggcggatcatttgaagtcaggagttcaagactagcctggccaacatggtgaaacgctgtctctgctaaaaatacaaaaattagccaggtgtggtggtgggcgcctgtaatcccagctactcaggaggctgcggcaggagaatcacttgagcccaggaggcagaggttgcagtgggcagagatggtgccaatgcactccagcctgggcgacagagcgagactccatcacacacacacacacacaaaagccggcgacacgcagctggtcaaaactgaagctccagctccatcgtgctctctgagtggctgcaggatgagggccaagtcagggtagagactggggaaggagcggccccctccctcagagccacaggaggaaagaggacctgccccagctcccacatgcttctgtccacacgcacacatgtgccagggctgcaggacaattctgtgacatgggaggcactgaagggaggcactgacattataccttggcaacgagacatgctgcagatggtcaggttccctaacagccatgctgcagaatgagaacacaggagatgaagtttagtctaggagcaggatttagggcacaagtgcatggaagccacccgagggtcccagtggaagggacacagcgtcagcctggagtgtggagcagaggccaccagaaacagtcacagaacaaccatcactgtggcgatgggcctggcgtgggcccgtgtgccagaccctgtaacggccaacgttgcagtctgaggtctacgttcggggagcctcacagcccacacattcaccagacacgtcgaagccaaggccgggcagagtggagtttcagaacatgtctacaaaccatgaggccccctcccatcaagagatggggtctgatattctgtgtttctaagaaataaatgcagcagaagtgacgctgggtgacttctgaagccaggcccaaaaggtgatctggcttctgtctcatctttcttgggatgttggtcttggagcctcccaaccaagctgagcaggagcccaggccccagggagaggccctgggtaggtgtctcagatgacagccagcatcaactgccagagatgcagggaagtctttgcagtgaccccagccactgtctgcccatgactgctgaggccccaaagtgaaccacccagctgagcccagtccaccccaggaagcccagggagagatagtaatcaatgattgtgattgttttccatggatggagtggtgtgttctgcagccatggatcactgacacgagtgggaattagcagacacagcaggggagagacaagagtggtcccaacagaggccatagcacaggcaaaggcctggagtcaggacagtatggcaggtggacgagtgacaggccacgttggctggagcacagagggcgagggcagaggagggagagatgaggctggggaggtcaggaaggcaggatcagaacatggagagcctcctaccttatgttctggaaagatcactccagctactgtgagaagaagggggacagggctgatggggatggggagacaagtctgaggctgtcacagagatgagggcagccccaccggagccctggagcaggacgtcgaaggcagggaggccagtgggcacgcgagctgctgaagagcagggctggcaggatttgggaacccagtgtaggggtgagagcaaagggagagttgaggatggctggtggaggaggggtggggatgggggagcagagaccatgcatgggaactctgggtaagcctggagttggagactggaggtcagaagggaggtcaaggctgactccagaggtatccaggtgacccttcaaggccacagagttgagcatgtctacactgggcagagcatagagagcgggcccaggaaggggagggggagttcccagagtgggacccccgcccacagccagcaccccggccagcatggatgctccacctgctcttccctgcactcaccagaacccccgttccaggcttcctggcattagacttctggggcttaggaacccgtaactgcagaaaggaagtgtgccaagactcaggacacagaacgaagactgcctgttggtcccttcctccaaaaagtgcatggtgcggccagcagcgtgagcacaagagttcccggtgaagctgcaaggcctcgaggcaggtagggcaagttctcagcaaagctcaggcgcctcgccacgtcccacaccgggaggtgggcaggagggtggtccctgggatattgctcacgtatgggcacctgctggagctccagagccccagctccctcaccccccgccaccagtgccttgatcagtgcagtccctgaggccacgtcagggagtgtttccaggccgtgtccagagatgccccagtagaggtgacaggtgacttcactcttggttctgggaccttctgtgtctggaagcgactaacagcttgggacccagaattgccttccccacccccagccacgcaattgtgggcaaggggcttgctctcccagccccagactccacacttaggaaaattttaaatgggagtgagatgagcctgttgcccaggtgaggctaaaataagggagcaagtaagcacaccctccgccagagctggacgcaggcaataactgtccttaggaccctgataactgtgatacttggggagctcagggaggccccatgggtctgattggctgctgtggtcacttctccccaaaccaggccagcctcgatggtcaaatgtgtcttacccaaacaagaccaagacaagcattattaggaaaaggatcataggtcgaagtgcgtggcattttggttttcctggaaaacaggagtagaaaaatcacatcactcaccctccttctctcacctgccccactttacctgtcccgccttgtaattcaggcatcacaccctgcgacgggccttcatctgccaagatggtccctctgccccacaggtgatgctctgagccccacctgagcatctccaaacccagtccagatctggccctcctcccactcagagaagagggaggcggtctgctcctcccagctcatcagcccgactgctcctgcagactctgagagccaccccggcttcccagtgacctccttccactcagcacccccttcccctgggagaccggaatgaaccacactgaaatgagcacgtcgaggtcactgtcgaacccaccgagggaggccaggacagcctcatggccaggctgagccaggagcccagaccagttcctgccagggagaggagccaccaacttcccctagtatctccctgctgtctcagaggctcatgttctggaaacaatcattgtctttaaggtgattttatgtatattaaagtcacgtacagtagtgcccttatccacaccttcgcttgctggagtttcagttacccatggtcaaccaaaggccaataataggtgagtacagtacagtaaaatattttgaggacaggcatcgtggctcgtgcctataatcccaggactttgggaggctgagccagcagaattgctggaagccaggagttctagaccagcctgggcaacatagtgagaactcatttctatcaagaaaaaaaaaaaaaaaacaattagctgggcatagtggtgcatgcctctggtcccaggaggctgaggtggaaggatcacttgagcctaggaggtgaaggctgcagtaagccatgatcacaccactgcactccagcctgggtaacagagcaagaccctgtctcttaataataaacaaaactacaacaacaaaaaacccacaaactaagatatatacacatttttttttagagagaccacattcacgtaacctttattacagtatattgtttttgttgttgttgttgttttgttgttgtttttgagatggagttttgctcgttgcccaggctggagtgcaaaggggcaccttcggctcactacagcctccgcctcccgggttcaagcaattctcctgcctcagcctcccgagtagctgggtttacaggcgcccaccactacgcctggctaattttttgtatttttagtagagacaggtttcaccatgttggccaggctggtctcgatctcctgacttcaagtgatccacccgcctcggacagtatattgttataattgttctattttactattaattatggttgttaatcccacccggtgcctaatttataaattaaaccctatcataggtatgtgtgtacaggagaaaacatactctctgtagggtttggtactatctgtggtttcagacatccactggggatctcggaacctatcccccgcaggtaagaggggactatcgttttcacaagggcaagcctgaaaggcgtctatctcctggcccagttcctattccttcccccgaaatcagtccctttcaactaattcatctgttacttcttatcttataatgcttgtgtgtgtttacctccacctttctaagtcctgtgaccacggagcgatttatctcgaatagcttcttgaaaccgaaacgtgggaggcaaaacatttgaactttacatgtcctaaattattttttccatttttgtagttggtagatcgtttggctgtagggaaatcttggtggaaataattttccttcaatgtggcaaaaatggttccattttttaaaactttgaaaattaatttaatttgagggataacttacatccaataaaatgtgcccactttaggtatacggttttgatgagtttcacacaatgtatgtacacatgtaatcaccccagtaaggtccctcctgaccctgacaaccatggatctgattccctggcgtttcccatacacggaatcctctgatacatgctcttttatgtctggctgcatcacaccgcatgctgttttgaagattcacctatattgtcacgtgtatcaatcgttcgttctttttcatttctgagaagcacgccattgttaatccgccacaattcatttattctgtctcctattgacagacactgtggttttttcactgttcggggccactagcaacaaagcttctgtaaacactcatgtgcaggtatttgtggacctgtgttttcatttcccttgagtaaataccaaggaatggaaaagatgggtcatatggtaagtgtatgtttaactttgtaagaaactgccaaactgtgttccaaagtggtgactgaattttccattcccgccaggaatgtacgagaaccacagtccttgccaacacttgatggtcactcttttatcctttagccatgctagtggatgaggagtggtatctaagtgtgtccaatgactaaggaggtaaatcatcttttcatgtatttattggccatttgcttgcttcttatgaagcctgtccagatctttagctcattttattatttatttatttatttatttacttatatatatttttggggggcacagtcccactccagttgcccaggctggagtgtggtggcatgatcatggctcactacagcctcgacttcctgggctcaggtgatcctcccacctcagccttttgagtagctgagactataggcatgcaccacatctagctgattttttgtggttttggtagagatggggtttcaccatgttgcccaggctggtcttgaactcctgggcttaagcaatccacctgcctcagcctcccaatgtgctgggattacaggcataagccacctcacccggccctctatttttattttttttagacaggatcttactctgtcacccaggttggagtgcagtggcacgatcacagctcgctgcaacctcgaactcctgagcttaagtgatctttccccctcagcctcctgattaggtgggactacagacatgcaccaacatgcccggctaattattctactttttgtagacactgggtctcattaagttgtttctctttttattattgagcagaatttatttctatattttggatacaagtcctttgccaaatacaaatattacaaatattttctcgccaggcacagagagacagacactgcatgttctcacttatctgtagtatcaaaacatcgaaacaattaaactcatggagatagagaatagaaggatggttcgcagagacttggaagggtagtggcaggggtgagagggtatgtagggatggttaatgtgtacaaataaatagaaagaatgaataagacccagtatttgatagcataacagggagactatagtcaataataatttaattgcacatttaaaaataactaaaagagaggtcgggcacagtggctcatgcctgtaatctcagcactttgggaggccgaggcaggtggatcacctgagatcaggagttcaagaccagcctggccaacatggtgaaacctcacctctactaaaaatacaaaaactaaggccaggcgtggtggctcacgcccgtaaccccagcactttgggaggccgaggtgggtggatcacgaggtcaggcattcgagtctagcctgaccaacacggtgaaatcctgcctctactaaaaatacaaaaaattagctgggtgtggtggcgcatgcctgtaatcccagctacttgggaggctgaggcaggagaatctcctgaacctgggagacggaggttgcagtgagccgagattgcaccactgcactccagcccgggcgacagagcgagactccatctcaaaaaaaaaaaaaagaagaaaaagaaaaaagaaaaaaaaagtttaaaaatacaaaaactagccgggcgtggtggtgggtgcctgtagtcccagctactcaggaaactgaggcaggagaatcacttaaacctgggaggcggaggttgcagtgagttgagatggcgccaccacactccagcctgggtgacagagcgagactccatctcaaaaaaaaaaaaaaaaaaagaataaaaataactaaaagagtatagttggattgtttgtaacacaaaggataattgctcaagaggatggataccagttctccatgatgtgaattttccattgtatgactgaaccacaatatctcagggaccccataaatatatacacctactatgaacccataaaatgaaaaacaaaatacttcttagaaaacaaatattttctctcagtcggtggcttatttattcatttttccttaatttttcttttgaagggaagtgttaatttttataaactctaatttatccttataaaaatgaaaccatttttatggtttgggccttttttttttttggctcatctattaaatttttgcctaccccaagttcatgaacattttctcttattttcttcagaattccataatttttgtgtattgtgtgaaaggctaaagtccctttcttccctcaatggatatccagtcatttcagccatttgaattgaaaatactttcctttctctatcacattaccttagcacccttatcaaaaagcaactattaaaaaatcaattgactatttctgtgtaggtctatttctaaactctgcattctattccattgaactatctgtctatcctaatatcaacctattctgattactatgtaaaattttagaatcagctgtcaactttacaaaaatttcttctggggttttaagtgagattatgtggactctgtagatccatctggggagaagtgacagtttagcaatgtaagtcttccaatccatgagcatggtatatttctccatttatttatgtcttctttaatttttgtcatcaatattttgcagttttctgtttttttgtgaccttctttttcttttttttttttttttgtcagggtcttgctgtgtagcccaggctggaatgcactgcaatctctgcctactgggctcaagtcatcctctcacctcagcctcctgagtagcaggggctacaggtgcatgccaccatgcccagctaatttttttttttttttgtagagacagggtctcactatgtcacccaggctggtctcaaacttctgggctcaagtgatctggccaccttgacctcccaaagtgctgggattacaggcatgagccatggtgcctggtttatattgcagttttaattgtatagacatttctcctaatttggtaaattattctctaaatatttcatgttttatgatgctactgtaaatggtatttaaaattttt

SEQ ID NO: 602 - DNA, 201 bp, Homo sapiens
ctctgaaattctctgagctccccttacaagcagaggtgagctaagggctggagctcaaggcattcaaacccctaccagatctgacgaatgtgatggccacrtcccggaaatatgaagacctgttatgggcatgggagggctggcgagacaaggcggggagagccatcctccagttttacccgaaatacgtggaactcatca

SEQ ID NO: 603 - DNA, 201 bp, Homo sapiens
tgacttcttcgatctgctgcatcttaaaagggcggaaggctataggagctttttggatggaagactttttcttcctgttcttggggctcgaggtggcatgyctcttgacagaattctcactctcctcatctccctgcttcattaagtcatcggctatgattcttggcatcacggaatgaatcatcctctctttgagggctt

SEQ ID NO: 604 - DNA, 201 bp, Homo sapiens; identical to SEQ ID NO: 254

SEQ ID NO: 605 - DNA, 201 bp, Homo sapiens
cctcctgcacctgctcttcttggccttgctgcctccggtccctgtcggcctgggagctctcagcctcgggctgttctgtccacgtgtgctcacttacagayaccaggaccttctcgtactcctgagatccaccgggctctagcccttcagtcatggtacttgttccctggaatgagtgtggaccttgcgtgacctcctctt

SEQ ID NO: 606 - DNA, 201 bp, Homo sapiens; identical to SEQ ID NO: 263

SEQ ID NO: 607 - DNA, 201 bp, Homo sapiens
ttcaattaggttccttggatgaacaagaaacaagtgtgacattttgtgtggaatctgaaaaccaccttagcatggctttacatcggatgcatcagttttcsaaaaagccagagaactgtgttctgttgggggagaaaaagataaacattctaagagaaacaatcatttcttaaatgtggtaaatagctaagccaaaccaaa

SEQ ID NO: 608 - DNA, 201 bp, Homo sapiens; identical to SEQ ID NO: 265

SEQ ID NO: 609 - DNA, 201 bp, Homo sapiens
gcttgtgacttttccatctcagacttttttctgagtctgagagatttatatccagccaggtatttccatctacttgttccacagatggctaaaaatataayctcttttctccttgcttttgcatttgtacaaccccccacccctaaaaatctcctccttttcctgtattccctatcttgatgaattatacctactctatag

SEQ ID NO: 610 - DNA, 201 bp, Homo sapiens
atagtcctatagtctagcaatataactttaagatttacataacagaatgaaagtcagaattgtattttatggcattaaataaattaactttatttctgtcyatatcaacatccaaagtttattaggaatttatttaaagaataataaaagcaataggacctaacatttaatgagtgcttactgtgtcaaataccattctaa

SEQ ID NO: 611 - DNA, 201 bp, Homo sapiens
acccaggaggcagaggttgcagtgagtggaaatcgcgccactgcactccacagccgggtcgacagaacaaaactctgtctaaaaaaaaaaaaaggcaggtsctaaaaacaaaaccagaaaagctattaggagaaacgtcataaagttggaaactgaaaagcatttcatttcatggaataaaattttgttcttcagtaatta

SEQ ID NO: 612 - DNA, 201 bp, Homo sapiens
ggcatttagatacaaacaggtctaatatttaagaaatgaaaagatgaatataaaaaaggtctaatatgtaagaaatgaacaggtgaatataatgaataaamagagaatctcagtaaagaaatggaaatttaaaaaaataaactgataggaggatccaagatggccaaataggaacagctccagtctatagctcccagcgtg

SEQ ID NO: 613 - DNA, 201 bp, Homo sapiens
ggcaaggtagaagggggctgggttattaggcttttgtaacagcccagccaacagaagaaaatagtggtttagattagggtagtgggactctgtatatgcastgaagatagaaccaacataatttgctcaaaaattgaatggatagttttatgtcatgctttaaatgattattttttaaattattccaggtttattagtata

SEQ ID NO: 614 - DNA, 201 bp, Homo sapiens
agaagaaggaaggaaattaagattagagtgcagacaaatagagaatagaaaaacaagagagatcaaagaagtcaacagttagttctttaaaaagaaagacyaaattgacaaatctgtagccatactgactaagaaaaataaaacaggtaaaactaaaatcagaaatgaaagtggggacattattagtcaccttacataaag

SEQ ID NO: 615 - DNA, 201 bp, Homo sapiens
tctccttttctattctctttgttgggaaattgtgtcactgcctacttagttgctgccagtagcatttggtatagttgaccactccctctttctcgaactaytctttccgaggtttatataactttatagcttacaggcttttctcttttatccaaccattttatttcactatacaatgttaggtatcctcagggcttgatt

SEQ ID NO: 616 - DNA, 201 bp, Homo sapiens
ccagctgagaaaatggctgaaacggtaaaatattttcttttgtgatctatggaacttctaacactgtccttttactgaaaggtgacatatcatggaaagcrtttggcattaggaattaggaaatgtgggatctaaaccactcatgctattgagtgtgttatcttggagaaaattatttcctcttctgcgctttaatatttt

SEQ ID NO: 617 - DNA, 201 bp, Homo sapiens
agttttggagacattggagttccaatccaactatagtgggaatacttcattgcttaccttggtcaaccacttacaaccctaaaaaggccatgctttggaartaagggtcatgtcctagagtaaggaccatgctctaggactaaggacaaaagcaaaataaacccatcctaacaaagcataaaacaaagtctgacaggatca

SEQ ID NO: 618 - DNA, 201 bp, Homo sapiens
gcttcatcttaaatgaggtgtatgagaaacatgctaaactatggttccctatctctgcttcacaatataaaggtgattccagaatttggaagcctcaactrtaacaaactagatgaagacagaagctgattagataaactgcagtggtcaggaagcctcaccaacagagcaaacaacctccatcttcagctgcttattgag

SEQ ID NO: 619 - DNA, 201 bp, Homo sapiens
tctttctatcctccagtccgttatccataagtgcttaaaagatatggtagttaagtgaattaactagaaccctctcaaacataggggtgaattaaaataayctataggcttatttaaaatgcaaataccgagctccattcctttcattcagaatttccaggggtgaagcccaaacagtgaattccagaagctctccaagca

SEQ ID NO: 620 - DNA, 201 bp, Homo sapiens
taggggtgaattaaaataacctataggcttatttaaaatgcaaataccgagctccattcctttcattcagaatttccaggggtgaagcccaaacagtgaaktccagaagctctccaagcaatcccaggagaaatttctgtttaaaaaaaaaagaagaagaaagaaaagaaaagagaaaagaaaagcaagcacagacctaga

SEQ ID NO: 621 - DNA, 201 bp, Homo sapiens
ttgctgtaacaaagtaccacaaactgcatggcttgaacaacaaaatgtattctctcagttctggaggctagaagtccaagatgaaaatgtcaacaaggctrtgctccttcggaaggcattagagacactctcctagcttccagtggcttgctggcagtctttggtgctccttgtcttgtagacgtaccacccttatctccg

SEQ ID NO: 622 - DNA, 201 bp, Homo sapiens
tcctgtttccaaatgaagtctcattctgaggtagtggggggttagtacttcaacaaataaagatttgggggacacaattcaacccctaaattgctaaatayagtagtcactttttagtcctagctgatttgtcctctctaatatttaatactgttgaccattccctgccttttgagatacgttcttttgatgacttccatg

SEQ ID NO: 623 - DNA, 201 bp, Homo sapiens
attccatgagcagataaatttgataaatgctgtattaaaagagaggctatactatgggacctctcagagtcctatagtataactttaatactaatgtacaytgaaactctgtagagatgcagtatgcaacattgcccacacttatttgaccagggatctctatccatagagcctgtggtaagaagaatgcttagattccac

SEQ ID NO: 624 - DNA, 201 bp, Homo sapiens
ttaaacatgtatcttttgttgacacatgattgttttgaaaattactttttctctgattttttttttgcattctttttagtgccagtaattttgaatatagrgtatagcatgtattagcattttcttggcatttcttcttggtaagtagtttctgttttgtttcctttttgttagtcaccgttacttcatccccaatccgag

SEQ ID NO: 625 - DNA, 201 bp, Homo sapiens
tcaagtgaagccccctgaaatacggagaataagaatcttagaggtaaatccgaggacaagcaggtataactaaggatgttggaaagggacggaggtctggytggagctcggtggccagtagctttggatttagggaaagattgttccgggaagactttttcagacagggatgaaacttaggtttcgacttccccggacagc

SEQ ID NO: 626 - DNA, 201 bp, Homo sapiens
taaatgtcaaagatgtggagaaattggaacccctatgcattgtttgtgggaatgtaaaatgttgaaaacagtgtggcagatcctcaaaatattaaacatasagttaccatatggcctagcaattctgcttctaggtagattcccaaaagaaagcagaaactagaataggtatttgtacaacagtgttcacagctgcattat

SEQ ID NO: 627 - DNA, 201 bp, Homo sapiens
aaaaaaaaagcaggggttgcaatcctagtctctgaaaaaaccagactttaaaccaacaaagatcaaaagatacaaaaaaggccattatataatgatggggkatcaatccaatgagaagagcgaactatcctaaatatatatgcacccaatacaggagcacccagattcataaagcaaacccttagagacctacagagaaac

SEQ ID NO: 628 - DNA, 201 bp, Homo sapiens
ctttaagaacctgccttctctgaatcttgctggcaatctgaagtgttccttctccatccttccattgtactttgcacttatatctgtaactgctctttacygtattaaattataatagttttattttccatccctctcccaaattgtaaactcctaaagggctggggactttgtgtttttatgtttcctcaaggtctggca

SEQ ID NO: 629 - DNA, 201 bp, Homo sapiens
atcttgctggatattttatatgaacagtgttaatttagatgcactaaagcaaaggtaggcaaactacaaccatgagtcaaacatggccacacccattcatktgctattgtctaagctggttttgcactacaactgcagagttgaatagatgcagcagatcctttacagaaaaagttttctgacctcaattctaaagtaatt

SEQ ID NO: 630 - DNA, 201 bp, Homo sapiens
gaagtcatgtagccagaggtcacaagatttgtaacttcaccaattgctcctttagataacatcactattgtaaaacctaagattggtcttgagatattttycaggcttctgcattctggcaaacctcctgatgccacccagatacatgcctcataccaagaaactgactctactagtcctatgactctcacctagacaact

SEQ ID NO: 631 - DNA, 201 bp, Homo sapiens
ctcccaagttccataagtctcagtattcctggctccttcctgcctctcagatctcttctcctccagctgtcctctcattccctaggccccagccacactakctccctcctgttcctctaatgcacctctgtgctcactattgactctgcctggaatgctcttctcctaggtttcacctggcaagctgctttctatcattga

SEQ ID NO: 632 - DNA, 201 bp, Homo sapiens
gtattagagcttgttttcatgtccatatactccagaactatcaaaattgatggtcttccttaaaagccttttgcatttttatatagttgatttattacacrtagaatcagtaagtgtcaaagagcaaattataggggaaattagaagaatgaaaacacaagaaacgtctaaccagtttaatcaggaaaaaaagagaagata

SEQ ID NO: 633 - DNA, 201 bp, Homo sapiens
ctctgacctcagcctcttcaatagctgggactacacacatatgccaccgcacctgactcgactcaaccctctttgagtagggaaggaaggcatcacagaaragacacctacactgggtctggaagtgaatccacctttgcaaaaattataacagtgagagaaatctaacctaactgactccatattgcttctaacctcaca

SEQ ID NO: 634 - DNA, 201 bp, Homo sapiens
agaggctgaggatacatgggcaggatccagggggtcctcagagtcacagcaccgttggcagccgctggccacagctctgtcaaaggtgagctccaccatasggatctcacacatcaggagaaagagcaggagcgctgcccagacgggacccagggcggctgtccccatggtgacctggaacaaggaaggagggacaggaac

SEQ ID NO: 635 - DNA, 201 bp, Homo sapiens
agtaagtgacaggagcacatcttcttgtccaaaatcattggaaatacataattgtgacagtttcccaaacatattcctttcgttttcaaaataatttttaraagtagtagtgtcttctagtggaggaacttccaaatcaactaactggtccttgaacttaagttttcgctcccttttatcattcaccggttcttgattctg

SEQ ID NO: 636 - DNA, 201 bp, Homo sapiens
cttcacttttctttgaatcagtatctttattttcattcattttctgtttgtgaaggaaatatgctgtaagattttaaaagataaggtatatgttatgcccrctctagaggaggaatggagtatggagattaatgctgtaggtaagctaattaacacagagaaacacaaaatagaatgttcaaaatgaacatgcacttgaat

SEQ ID NO: 637 - DNA, 201 bp, Homo sapiens
tctcaaaggttgacagactgacatgcagaaaacaaaaaataaaaagaatgaaaagcaaagacgacctagactaaaagaaaatttttttgtctcttctaacrgcaagcagagacaaacattaaattgcaatatcgtacaatcattcaccatctgtaattcacaatctatagtgacaatcttgagcttctaaaaaaggttgat

SEQ ID NO: 638 - DNA, 201 bp, Homo sapiens
ccaagagaggcaatgtaaaattaaatttttagatattcttcaagttatagacttaaggtcttttaaaatggaaggttaaaatgaattgtaatattgagtgyacttcctagatgtggtgtagttgtaatgacctaatgttgctactgcttcagcgcttgaaaaaagacgctcccaaaaaaggttattcactgctaaaggttg

SEQ ID NO: 639 - DNA, 201 bp, Homo sapiens
ccttctagtcaagtttgatgagagaacctggataccttggttgccagtgaaggattcacatgcttattatgtttttttccgataggagcctctgagccccmctgcttctagtcagccatcttggccccgtcactcctattatttttacctcatttccttttcttaatgaattggattgaaacaccagaatacagttattta

SEQ ID NO: 640 - DNA, 201 bp, Homo sapiens; identical to SEQ ID NO: 612

SEQ ID NO: 641 - DNA, 201 bp, Homo sapiens; identical to SEQ ID NO: 613

SEQ ID NO: 642 - DNA, 201 bp, Homo sapiens; identical to SEQ ID NO: 614

SEQ ID NO: 643 - DNA, 201 bp, Homo sapiens; identical to SEQ ID NO: 615

SEQ ID NO: 644 - DNA, 201 bp, Homo sapiens; identical to SEQ ID NO: 617

SEQ ID NO: 645 - DNA, 201 bp, Homo sapiens
tacttcggtggtcagacaaataaattaatattctcttcattcccccatacgtcttctgaattgtatttctgttttcctgagaaaacccatcctcctttgayatttgtatcatttggctctattaaaaatagttatgtaaccacctctgatcactcctgactcaatattcctctccatgccagtcccaaggtatatttttaa

SEQ ID NO: 646 - DNA, 201 bp, Homo sapiens
atatttttgaccctcagcttctttttttcctaatcaaaaccaaaactttacccaagagagttgccaaagaaaataggatttttgctctagctttgaggcaygtcaaaatggtcaactagaattttctcaaattctgcttatctttatgtataaaggcaaagcaagatgaatttagattgtggtgaaagttgagatgatttt

SEQ ID NO: 647 - DNA, 201 bp, Homo sapiens
tgaaagcaataatgcaaagctaatacagtttgtgaactaagcttgagccatttttaggacagtctttcacagtcctttcacttactttagtctcataaacycaggtctctgaattcccagcccagaaattaggacgtgataatttcaaaaaagaaaaacagttgtgttgttaaaagtaggtactctgacaccagaaaaaaa

SEQ ID NO: 648 - DNA, 201 bp, Homo sapiens; identical to SEQ ID NO: 626

SEQ ID NO: 649 - DNA, 201 bp, Homo sapiens; identical to SEQ ID NO: 627

SEQ ID NO: 650 - DNA, 201 bp, Homo sapiens
actctcacacactgttggaggaactataaattcatattatcttttgggaggttacttttgcatctttaacgaaacatttcactctaagccttcaaacattwtaaattcacctctgaagaacttctcctacagattactgatgttcccatagaatgtacctcttcactacagcactgttaactaacgcaacattggaaccaa

SEQ ID NO: 651 - DNA, 201 bp, Homo sapiens
tttctctattttctgttttagtttttttaattcttttaaattaaataatttggtgtctttaatttgctaaagatttacataatatttctatacgtctagtsttaagtgagaccagtctctagggttttgtgggggggtgtgtgtgtatctttgccctgtttgaataacaaagttacaccttgaaaaaacgaattgatagtt

SEQ ID NO: 652 - DNA, 201 bp, Homo sapiens
atgctgtgctgcttcttcacccaatcccaaattcctcctgtccttcataacccttgttagttctctgtaattcctactcaatgatataaaaactcccaaayaacatccatcctcccaagtcactgaaagggatctggccctaaatttcctatcttatgcaaattctgattctcccccaagccacatcttctctgaaacaga

SEQ ID NO: 653 - DNA, 201 bp, Homo sapiens; identical to SEQ ID NO: 629

SEQ ID NO: 654 - DNA, 201 bp, Homo sapiens
agatcagatgagccagtttattgatctgagtggtgccagctgatccatcaagtgcagggtctgcaaaatgtctcaggtactgatcttaagggcagtgtatycttaaatattgtagcctctagctgcatgattcctaaaccataatttctaatcctgtggctaatgttagtcctacaaaggcagtctagcgcccaggcaaga

SEQ ID NO: 655 - DNA, 201 bp, Homo sapiens
ctatttactatgtacaaatacagcacaattatgtgcaaatattgcacaatatactgtacatttatttttgcaaataccccatttaaaaaattataatactyggaatgccatgaggcctgaaggcccatcatcgtccaagaagctatcagcagtatggccatagctgtgttttccgtggtcactgactgaaacataaactcc

SEQ ID NO: 656 - DNA, 201 bp, Homo sapiens
acaaatatgaaaaacaaaaaaaattaatttgggattctatatggcattttggagacatttcgttaagaatattaggctatattcttaatctgaaactaaamtcctggaaataaaagaattgtaagcatagaacataacatgaaacacatgcaaataaaagaattatagtccaagtcttcctgttgcctcctaaacctctac

SEQ ID NO: 657 - DNA, 201 bp, Homo sapiens
aatcctttacagacaagcaaatgctgagagattttgtcaccaccaggcctgccttacaagagctcctgaaggaaggactaaatatgtaaaggaaaaacagrtaccaaccactgccgaaacatgccaattgtaaagaccattgacactatgaagaaactgcatcaactaacaggcaaaataaccaactagcatcataatgac

SEQ ID NO: 658 - DNA, 201 bp, Homo sapiens
ttttttaaaaataacaaccctcaaattctaatgtgtaatttgctagtttattatgtttgttgtttgttgtctctctctcatgaagtcaaagatttttgtcrttttgttgatgtattctaagcacctagatagagtagccagtcaataaacatgtgttgaatgaaggagcaaaaagagcctgagcctcttgcagcttttcag

SEQ ID NO: 659 - DNA, 201 bp, Homo sapiens
ctgatggtataattttgtcctttgcctcccttctctaacattagagaaaagttcccaggtttaaaaccatgttcagtaacctgatccattatccaagataytctctatattggagcaagtcagatcctgtcccaccatttatcagtcgggaatggaagggacataaggagaaacacagagaagccctccggcagctcacca

SEQ ID NO: 660 - DNA, 201 bp, Homo sapiens
gatacagtataggcagattgtcagaagacaaagagaatcttgagaacagtgagagagaggcaactcatcctgtacaagggagccttaataagattaacagytgatttcgcatcagaaaccatggaggcctgaaaacaggaggcctgatgccacttcacacctactaggatggatataattttttttaatggaaaataacaa

SEQ ID NO: 661 - DNA, 201 bp, Homo sapiens
agcatcatatcatatgaaaatatataaagttgtaaattaggctaacatactgttatataaaatttattctacccacctactttcacaaacatatctttgaratgataacattgaaaaacgggtaagcagctatgggctttatgtaattgaaagatggcaagaaccaaagatggtaagcttagttattattgtacatgtctg

SEQ ID NO: 662 - DNA, 201 bp, Homo sapiens
atcactggcccatgcatgcttgtttgttcagttgattttagtagttaataaaaattgatgggaacctatcctcaaaacaggaccttaacagtaatttatgyatatcgaggtggttctttcccacctcatccccacgcccccatctcctttcacccatcctgaatgctgtgttcatcattctgtcactttctgttaagattt

SEQ ID NO: 663 - DNA, 201 bp, Homo sapiens
tgggaccctgggtcagcagagctacagggacaggacacttacctagagccatggggatggggcattgtagagtcaaaggggcagagccatgggaatgatgytgccaccccagtgggcttagaaagcaagacactaagccaaagaagactatactcaagaattaagatccagtggaatttgccttgccaggtcgtggacttg

SEQ ID NO: 664 - DNA, 201 bp, Homo sapiens
caagagtctcacttcacagtttaaggactcacatagactgaaagtgaaaggatgaaaaaagatactcaatgcaaatggaaaccaaaatagaacaagtgtarctaaacttacatcagataaaataggttttaagtaaaaaactataaaatgagaccaaaaaggtcattgtgtggtgataaaggggtcgattcatcaagaggc

SEQ ID NO: 665 - DNA, 201 bp, Homo sapiens
tgaaatagaaactagaaaaataatagaaaagatcaacaaaactaaaattcggtattttgaaaagataaaattgacaaacctttaactagactacttaaggmcaaagagggaagacttaaggaaaatcagaagtgaaagaggagacattacaactgataccacagaaatgcaaaagataagactactataaacaattatata

SEQ ID NO: 666 - DNA, 201 bp, Homo sapiens
atatctacccccaccacaatgctatttaatactgtattaatcgttccaactaatgcaataaggaaagaaaaaaagcataaagatcagaaaagaagaaaacwgtctttctttgcagaaaacataattatttacattgaacatcctcagtaatactaaggaataactactagaactatttaataaagtcacagttatatctca

SEQ ID NO: 667 - DNA, 201 bp, Homo sapiens; identical to SEQ ID NO: 270

SEQ ID NO: 668 - DNA, 201 bp, Homo sapiens
atattgtctataaaatgtaaattcaaggaccaaagcatttggctaccttattattgtgataaaagcaagccttaaggttggggtagtcatttttctgacaygcaaatttaataagattaataatttacacaatttgcattgaatgcatctgcctttacttctgattatggtacctactctatgacatccatagtgacctgt

SEQ ID NO: 669 - DNA, 201 bp, Homo sapiens
ttacttataatggcttgagttaaaatgctccaacttttctaatttttgcttttgaaaataaaacacctatagtgacaataaaaacacacatttaaagccawgtggtcatagtgactggagccatgtagtgaattggggctagactagtacgatcaatagcgatacaaaatcacaatgaactgtctgaggcagaaaactttt

SEQ ID NO: 670 - DNA, 201 bp, Homo sapiens
acatatccaggaagctcaacaaagcccaagcaaaataaacacgaagagatacaccaagatacagtataggcagattgtcagaagacaaagagaatcttgaraacagtgagagagaggcaactcatcctgtacaagggagccttaataagattaacagttgatttcgcatcagaaaccatggaggcctgaaaacaggaggcc

SEQ ID NO: 671 - DNA, 201 bp, Homo sapiens
ggtatttgcaagacccaggtcaagaggatgaattgaagcatcatatcatatgaaaatatataaagttgtaaattaggctaacatactgttatataaaattkattctacccacctactttcacaaacatatctttgagatgataacattgaaaaacgggtaagcagctatgggctttatgtaattgaaagatggcaagaacc

SEQ ID NO: 672 - DNA, 201 bp, Homo sapiens
ctaaggctcaaagagaagtataagactaggtctttatatttgtaagttacttacactctagatatcaaacgaaatgtaactcacatgaagtgcttcaatgytgaataggttggtacaaactcaagtgcggtaagtggtaaatctgggctgatgtagtcagaggagacttcctggaggatcttggacatgagctttccaggt

SEQ ID NO: 673 - DNA, 201 bp, Homo sapiens
aaattcagctctggtcttcccgagtgtaaagccttagccagattatttgtgttgctggagcaggcacacttcacttaaaaaatggactgatataaagcccyagttaattttttttcccagatagctataactcataagagattcagatatgatgagtaaatcatctggatgaacaacttgtgtttagcactgttctttact

SEQ ID NO: 674 - DNA, 201 bp, Homo sapiens
gttgtgacacatcgagatacattttcatctgtgggggagcctacagtcagctttattcatgggcaacatcatgtctcaataaatggaaaataaagcaccartgtggtctgggatatttctacattcaatttaaacttgcaaaatctgaacattggttgacatctactaacttgcaccatcatatcaaaaaagacactctac

SEQ ID NO: 675 - DNA, 201 bp, Homo sapiens
gccttggcactagtcctagctcttacccaccccccaccccgacccaagacactgggttcacagtcaggatgccttgcgtgctagctagagctgatggggcmtttcctagttaaaagacaaattatggaattcttccattaagagatgagtatataacaatatacataaataacaatatgctgaggtacttgtggttgggtt

SEQ ID NO: 676 - DNA, 201 bp, Homo sapiens
gccgagatcgtgccattgcactccagcctgggtgacaagagcaagacttcatctcaaaaaaaaaaaaaaaagtgcttggcataataaaaatgcttaagtartgttaggttttattattattataattcatagacacataaatttgtatataaaatgttaagattgaatagaaaaccacaaattcctttttgtgtttacttg

SEQ ID NO: 677 - DNA, 201 bp, Homo sapiens
tgtaactataaggtgttttatatattcctcatggtaagtacaaaacaaaaaacctatattaaatacacaaaaggtgaagagtaagaaatcaaggcatggcrctagagaaagtcacctaattacaaaggaatacagcaagagaggaagaaaggaataaggacctacaaaacaaccataaaacaatgaaccagatgatagtag

SEQ ID NO: 678 - DNA, 201 bp, Homo sapiens
taattgtaattaatctggacaattatactaataaatgacaaatacctcaaagaatcgaacaagtgcttttttagggtcttctgagatggataaatattcarcttgggcctttgagaaaatactctttacttctgagagattaaatagtaatcttgtcagtttgaccaactgtttcatgtactctttttctgttaaaataaa

SEQ ID NO: 679 - DNA, 201 bp, Homo sapiens
taatttttgataatacctgtattgtgtttatatttctctctctttctccttttttaggtataaacaacataaaactgacttggaagcgattcctcagcagygccccattgatctgccctgccaagtgactggctgccagtgcagggcttacctttatgtccccttgaatggtagccagcccattcgctgcaggtgcaaaca

SEQ ID NO: 680 - DNA, 201 bp, Homo sapiens
atataatagaaattgtaatttttgataatacctgtattgtgtttatatttctctctctttctccttttttaggtataaacaacataaaactgacttggaarcgattcctcagcagtgccccattgatctgccctgccaagtgactggctgccagtgcagggcttacctttatgtccccttgaatggtagccagcccattcg

SEQ ID NO: 681 - DNA, 201 bp, Homo sapiens
ttttggtccatattgagaagtgtttgggtaaacatttgatgagccacgcgattctttcgcaaagagtctaccaagatcagggccttgtcttcaattttggyatcataatattttttcttttcctcttccttcaatgtcagaacatcgtgttttgccaaataattaaaaacaccatgaagaacatctttgcccaggtattcc

SEQ ID NO: 682 - DNA, 201 bp, Homo sapiens
ctctggtcatgtacggcctcttccctttgattatctgtaacctctgacccctggtcagctggggcctccgccctctgattatctgcagcctcttccctgtrgttatctgtgccctgtgacctctggtcagctggggcctctgccctctgattatctgcagcctcttccctctggttatctgcagcctctgccccctcctca

SEQ ID NO: 683 - DNA, 201 bp, Homo sapiens
ccactggattgggaactggagctgctgctgaaggagccggtgcctggtggggagcaggggctctgggaagcactgccgcagggatggtagggtaaaccggmgctgctggaaatgctagaactgctggggactcgagaactggagggagagcagggtcccttggagcccgtggagccgcctccacagagctggaccccacca

SEQ ID NO: 684 - DNA, 201 bp, Homo sapiens
agcttccccttagtacattgaaattcaaagtcatgcttgtaactgttaatgaaagcagatttaaagcaacaccaccatcactggagtatttttagttatayacgattgagactaccaagcatgttgctcttattcagtgtaatcctaatctcatgggtatccactgttgggggagaaggtaagttgaaaacagatccgaat

SEQ ID NO: 685 - DNA, 201 bp, Homo sapiens
aagaactgctataacatgtttctaaaccagggctatgcaaagcactagagttcctgaccagcaatgcaaaccagtggcatacaaattcaaaatactgtatmcaggccctgactccagcccaaaccaaggctggagggcatccagggggatgtggttccccacggggtagcatcttggttatgtgagatcaccaagacacca

SEQ ID NO: 686 - DNA, 201 bp, Homo sapiens
ggcggcccctgttacctgtatgctgtccagctgctggggcaggatgcggagaaagtcatccggaaggttgcccagcagtggtgggttccagttccgatagygtctctggcttgtaggggctccagagcccagcgcgtcgatactaggggatggcaggtgacagggaagaggaagtcattaagcccaaccccaggtctcctg

SEQ ID NO: 687 - DNA, 201 bp, Homo sapiens
ggcaccttctcttgggccaaaacaaataagctagggtaagcagcaagagagccacgagctcccacatggtggctgggtgccggcaggcaagatagacagcrgtggagtagaagagctgtggcaactctagggcacaaggaggccttttaaagggctaccctgatcttcaccttgactttgtgttatctcttgccttgtgga

SEQ ID NO: 688 - DNA, 201 bp, Homo sapiens
tttgaggccgcccagagaagtccttgcccttcttaataagcacctccttggccagctggtggtggccgacaatcactgtagtcttggtgcccatacgaacmgaatagatggggccatattttttctgcagcttgaagaagttgttatgcatatggccgtgtctggggaggaatggcaggctgcccaccaggggcagggaca

SEQ ID NO: 689 - DNA, 201 bp, Homo sapiens
ggtggtggccgacaatcactgtagtcttggtgcccatacgaaccgaatagatggggccatattttttctgcagcttgaagaagttgttatgcatatggccrtgtctggggaggaatggcaggctgcccaccaggggcagggacaggaggctcttggggtacttggcaccagggcaccttctcttgggccaaaacaaataag

SEQ ID NO: 690 - DNA, 201 bp, Homo sapiens
gcttccagaagatggggcagctctactctggggtcaaagccaactactgcttgggtaaggagcagggcaggcctagtcttcctgcacagaaagcctgagasaattggctctccctttctctggagcccagagattgggctggctggggtctaggatcaatgagggggaagcacacctgaggattgtgcagcaggaaggcca

SEQ ID NO: 691 - DNA, 201 bp, Homo sapiens
gggctgggcgcagtggcccacgcctataatcccagcactttgggaggccaatgcaggtggatcacatgaggccaggagttcaagaccagcctgactgacaygccaaaaccccatctctactaaaaatacacaaattagctggtcatggtggcgtgcatctgcaatcccagctacttgggaggctgaggcaggagaatcgct

SEQ ID NO: 692 - DNA, 201 bp, Homo sapiens
tgtagaaaactgcccctgtgagcctgagtagctggaaatagcaccaggaaagcagcaatcccagcctgcaatagctaggctaattctccccagcagctttyatggaggacagtagtcactgcccccattttccatgaaaagtaacatgaatcctggctgtataaggggcacttactgtgctgggtgctaggctaagtgctg

SEQ ID NO: 693 - DNA, 201 bp, Homo sapiens
gacagaccctaaggcctcctactcccaattccttcagaaatacagtagatcaaggagaaagaaagaacccttaattagaatgcagcagcattggggttctkttcgctgacagggtgccctctgggcttctttttgctcatcagtttctgaccacaggaaggcaactctggatgggataaactctctaaactatgcctgtcc

SEQ ID NO: 694 - DNA, 201 bp, Homo sapiens
cgatcccatagttccacgtctaatgttcccttttcaggaaacaaaggacaatgttcttccactgccctgaatagggtgaccatattttccatgggtacccraactcccccctgttttaacaggagtttaatatggcagagataagcataatgtttagactctgagtgacccaaagttagcctggacaatacacagacaact

SEQ ID NO: 695 - DNA, 201 bp, Homo sapiens
tacatgttcttaaagggtcatgaaacttactcatattatgggcctctgaatttacttaccttcaatgtgggttatcataatgaacatcatgatttccccarcattcctggaaaaagtcttccactggtaagtaaaggatttgatacatattctaattttgttttttcatttgtttgttttttgagacggtgtctcactcag

SEQ ID NO: 696 - DNA, 201 bp, Homo sapiens
tttcagacattatcggtctgctcgggtagagactccatcccatccgggtggtgtgagcgaagagttttgggaacgcagtcggcagagagagcgggagcggmgggaacatggtgtctatgcctcgtccaaagaagaaaaggattggaagaaggagaaatcgcgggatcgagactatgaccgcaagagggacagaggtaaact

SEQ ID NO: 697 - DNA, 201 bp, Homo sapiens
tgaggagcgtcctgaaaagtcgcgtctccggccccagccactgcggggatgatgccactggctcatgtgggtcccaagaagccgcccacccaatgccaagycggccaaaagcgccagtccggcgccctcaatgccaggataagaccctaaacaggaaaagactcggcagccacctacgccgcgctccagcgtctcgctatt

SEQ ID NO: 698 - DNA, 201 bp, Homo sapiens
atgggcttaaagaatgtgaacgatgtgctcacagaggccacagaagagaaattatagccaggagaacaacctgaaagacaaaggacacggtggcataagcrcatgtaacacaatgtactcaggaaatggctggcatcctgagatatggagtggaatacagtacagggctttgtaaactcagcttggagtcagatcacagaa

SEQ ID NO: 699 - DNA, 201 bp, Homo sapiens
gatggttgagtccagacagcagaggattactggggaggaaggggaagaggagaggcctggtgaacttgtggggagccacctaccaggaggttgaagctgtrcttgatcttctggaagcagtcaatgtactgtgcctgggtgagacctgggagaaggggccaagacggtgggccagagatcaccctgagacacccctactcc

SEQ ID NO: 700 - DNA, 201 bp, Homo sapiens
ctgcttccctgtgggttccggcttctgcagagctgtaagagttgaatgccacacacagtcacactaaggaatgctccaggattgggaaagaaaattcaacmttataatgagaacactgtgaatgctattgaattaactactcccctctctccctatttcttgtaagtcttagtgtcagtaaactaattataaatttacatt

SEQ ID NO: 701 - DNA, 201 bp, Homo sapiens
aggatctgaacacagagagcggcggggccggcggggaaggagggaggaggggagagcgctgcttccctgtgggttccggcttctgcagagctgtaagagtkgaatgccacacacagtcacactaaggaatgctccaggattgggaaagaaaattcaacattataatgagaacactgtgaatgctattgaattaactactcc

SEQ ID NO: 702 - DNA, 201 bp, Homo sapiens
aacccatctctacaaaaaaatatgaaagtatctgtgtgtgtgtgttgctgtgtagtggactacagaactttagaggcagtcacttatttgaatcccattgycgtaactttctactattttatttttccactgtgactcagggagattcaggtggtcccttagtttgcaaacacaatggaatgtggcgtttggtgggcatca

SEQ ID NO: 703 - DNA, 201 bp, Homo sapiens
ctcacaggtgaaatccaaaatattctacaaaaggtaaatattcctttggtaacaaatgaagaatgccagaaaagatatcaagattataaaataacccaacrgatggtctgtgctggctataaagaagggggaaaagatgcttgtaaggtaactcatgagattatgaaaaacacaataggctgcttgagaaaattcatttca

SEQ ID NO: 704 - DNA, 201 bp, Homo sapiens
agggatgaaggattgaaggttagaacaattaagcaacttgtgcaggatcaaagtgagttggatgaggagttagcggtgagggtgaggcttgtctctctctygccctctcatcctggcacatgtgcgatatcgtgctgaacctgagggaggaaaatacacgacaacaaggcaaaaaatgaatatagtaaacaaagaaaacac

SEQ ID NO: 705 - DNA, 201 bp, Homo sapiens
taaaatttactattccagaacctagagcagggattggcaaatgtcttcttaataacgcagagtaaatatgttaggctttgtgggcaaaacccacagtaaarccaaggatattatttaagtatttatgtcaccacttaaaatgtaacaatttgaaaatataaaaatcattttgtatagctaacaggctaaacagaaacacac

SEQ ID NO: 706 - DNA, 201 bp, Homo sapiens; identical to SEQ ID NO: 300

SEQ ID NO: 707 - DNA, 201 bp, Homo sapiens
actccaccatgcccagctaattatttttttgtatttttagtagaaacggggtttcaccgtgttagccaggatggtcggcttccggtgttgtttcagcatayggctaaattaaaggcttagattctcagtttgctcattctaatttagctgaattctgagtattatgcatttgtatctgaggttccaggcctctccctcctc

SEQ ID NO: 708 - DNA, 201 bp, Homo sapiens
tgctgacagcaatggcaggctgccatccttggagtgaggacctgtgcttctacttcctgcttcctctgaaccccagcagctgccagcacagcgtctaggartagtggctgtggacataattaggagtttcttgagcagcctagttaacagccccacagagggcatgatcatataagaacgtcactcatgtcattatcattt

SEQ ID NO: 709 - DNA, 201 bp, Homo sapiens
tatttaacattcctctcaagcaaatacgccttgaaatgctttttttaaatcataggaatttaaaaacactttacaatagagaatgattgatttttaaaatrtgtctgatttagctttgtagagatgttccgctaatatccataactaatctgagaggaaatgtggaacaacagaagagtaacagtgtctactcagtaacaa

SEQ ID NO: 710 - DNA, 201 bp, Homo sapiens
agggtttggataaagagacgcaattaggaaaggaaaaagcagaaggctcgttccagacctggatgagatcctaaaaagcagcagcttttgccagtaaagayccttgaaatgattcaattaccctcaaagcactccttgtctccaagacaatcactcataagcacaattccattgaagccaacgtaccattttgtgattttc

SEQ ID NO: 711 - DNA, 201 bp, Homo sapiens; identical to SEQ ID NO: 329

SEQ ID NO: 712 - DNA, 201 bp, Homo sapiens
tactaggaagactgacaatagagcaagctcagaaaatttttatggaggtgatttagttagaaaatttgtctgcaacctaagggccatggagtgtgactccrtggtttatgggtgtaactccgtggtttatgaagagtactttcaaaataggaaaatcttcacaactaagtgctagcatgagctgactttactttctctagg

SEQ ID NO: 713 - DNA, 201 bp, Homo sapiens
caagacggaaattagaacagaggttgccaggggccgaggggccaggggaagggctgagggttggtgtttaatgggcacagagcatcagctggcgaagttgraaagttctggaggtggatggtgctgatggttgcacagcaatgtaaatacccttagtgccacagaactgtacactcaagatggctacatggcacatggtat

SEQ ID NO: 714 - DNA, 201 bp, Homo sapiens
cattggattccttacttaggtcactttcagcgttggccaaacaaaaaggctccagctgggggtatatatattccagggaagttaagttggccaaactttcmgtttgctacttcagtatcctccgagttgtttccagacacagttttgtgtgctttttagttttggttttcttttttaatcaatctgcagcacactcatgtt

SEQ ID NO: 715 - DNA, 201 bp, Homo sapiens
ttagagcctttctgtttctctcaatagggttggagagttatccttatcttctttttattggggcttaagaagagagatgaggttccatggagtaaacaatwcaaggatataaggacctcatataatctcacgtatccattttccatgaaagccattcttggcacgaatttgccattctatgtttgagcctcataaaaggca

SEQ ID NO: 716 - DNA, 201 bp, Homo sapiens
agcaacagagcaagaccctatctctaagtaaataaataaaatacagaacgagttcggtatgcatcctcacattggattccttacttaggtcactttcagcrttggccaaacaaaaaggctccagctgggggtatatatattccagggaagttaagttggccaaactttccgtttgctacttcagtatcctccgagttgttt

SEQ ID NO: 717 - DNA, 201 bp, Homo sapiens
tgctaacaggccatggaccaggtactgttctgggccccgggggttgggaacccctgctcagagacacaccgggtggtaggaggagctaaaggtggagaggstgaaggaaaatatgaggtctgggctatccacaaaccagatagcaggaaactgaagagttaaacatttacttcagaattgaatggcttttgtaaaatctgg

SEQ ID NO: 718 - DNA, 201 bp, Homo sapiens
aaaagttgtcctccagacaactcagccaagggaggccctgtgtgccttgcctatcacatgagcctcactttccactgagtgaggctgtcatttcagaagcrccgggtctgtcacatgaaaatatatctgttaccatcacttactaaacaaatttagtagaatttgtttggtgcttattatgtatcaggcattgttctgaag

SEQ ID NO: 719 - DNA, 201 bp, Homo sapiens
gactcgtcagccagtgagtaggtctgggtagcagttggcatggatgaacatgccctccataggctttcagaccttcttcaaggccaaagggaaggccttcrtggaaatataattatgtgaaacaccccagaattttttcacaaactttcctgcctataaacgccaggtcctaccactgtccagtgtcccacttcccactgt

SEQ ID NO: 720 - DNA, 201 bp, Homo sapiens
aacgctcaccccactcccatcctcccatctagtggcatattgaaaatcaatttgtcttgtaaaattaaataatccaattaggagggggatatattctaagraaattagtgcatgatgcacacacacacacacacacagaacacgtgtgtgcgcatgtgcacatgagagagagtgagagagaaactgggtcttgctctgtcg

SEQ ID NO: 721 - DNA, 201 bp, Homo sapiens
atttctttgattatcaaaagtacactagctaaggttgctgtccctcttttatttatttatttatttgagacagggtcttgctctgtcactcagatttggtygcactgggtgtgatctcagcccactgcagcctccacttcctaggctcaagcaatccacccgtctcatcctcccaagttgctgggaccacaggtgtgcacc

SEQ ID NO: 722 - DNA, 201 bp, Homo sapiens
taaataattttttttcccatagaaaaatgcactaagcctgacctgagtaatggttacatctctgatgtaaagttattgtataaaattcaagagaacatgcrttatggttgcgcttcagggtacaaaaccactggagggaaggatgaagaagtggttcaatgtctctctgatggatggtcttctcaaccaacctgtaggaaa

SEQ ID NO: 723 - DNA, 201 bp, Homo sapiens
gtagggggccactcatattctgggctcctggaaccaatcccgtgaaagaattatttttgtgtttctaaaactatggttcccaataaaagtgactctcagcragcctcaatgctcccagtgctattcatgggcagctctctgggctcaggaagagccagtaatactactggataaagaagacttaagaatccaccacctggt

SEQ ID NO: 724 - DNA, 201 bp, Homo sapiens
agtgtcttggcttaggtgtctcccaactttatgtgctagtaatttcatccaggagaacctgtgctttgctgcttgatctctttctaccttgggtcccttaygcttagcatgttcttgacttttgaattctccagcaccaagtgaaagtagacgtatccctgtgacatctggctgtagaggatcctctatagggtcttcaga

SEQ ID NO: 725 - DNA, 201 bp, Homo sapiens
aagaataatttgaaccaacaattatatctgtgtttgaagaaacgaattcagtgccattctccagagctagggcagtaagattgaactcttcttcttcctgrttcaatgatgagtttcggaatgacctgattcctaatgctgcagccagtctgttctggtaatcatagtcagcatcactctcttcatcttcaggttctaaac

SEQ ID NO: 726 - DNA, 201 bp, Homo sapiens
ctgtgtttgaagaaacgaattcagtgccattctccagagctagggcagtaagattgaactcttcttcttcctgattcaatgatgagtttcggaatgacctrattcctaatgctgcagccagtctgttctggtaatcatagtcagcatcactctcttcatcttcaggttctaaacgatcatgcattttccgtgtagccatga

SEQ ID NO: 727 - DNA, 201 bp, Homo sapiens
cccaactttatgtgctagtaatttcatccaggagaacctgtgctttgctgcttgatctctttctaccttgggtcccttatgcttagcatgttcttgacttytgaattctccagcaccaagtgaaagtagacgtatccctgtgacatctggctgtagaggatcctctatagggtcttcagaatatgggctggaatgctctgc

SEQ ID NO: 728 - DNA, 201 bp, Homo sapiens
aatgccccattatttagccaggagacctaacatgttctagccagaagaaattctcagaatttctgaaaggttacttcaaggacaaaatacctgtattcctygcctgtccagggatctgctcttacagattagaagtagtcctattagcccagaggcgatgtctctcatgatgtccacgtcactgtagtatggtcttgttaa

SEQ ID NO: 729 - DNA, 201 bp, Homo sapiens
caggaaactgattccaggtttcagctactttctccattgtgaatcatggtggcttctctccacccaaagggaagtactgcaactcctgacaggtgtgccayggcaggtttctagtgcacctatttattgatccctcttcccacctccagcccttcagcagccaagtggggcctggatcagccaagccttagatttattgct

SEQ ID NO: 730 - DNA, 201 bp, Homo sapiens
tgagaaatatcaggttactaatttttcttctatttttctagtgccatttccatgtggaagagtttctgtttcacaaacttctaagctcacccgtgctgagrctgtttttcctgatgtggactatgtaaattctactgaagctgaaaccattttggataacatcactcaaagcacccaatcatttaatgacttcactcgggt

SEQ ID NO: 731 - DNA, 201 bp, Homo sapiens
catataatgggaattctccacatgtacaaaccacttcatatgctaaacttgttgacaacattcaaagctcatccctgaatttgactatattgattacatcraaaatgttacatagcaaccttagaatccttgtgtaccttttcttctcaaagcctagattatttctttttccgacgtttcagtaattggagcagtaaaccc

SEQ ID NO: 732 - DNA, 201 bp, Homo sapiens
ctagaaggccttttagtctgcaaaagaaaccttcttaatcataagcagcagaagtcccatttaccaaattggaaagttaaagttacaaagcatcaatcatmagacttccattcagggatggcaattgggagtaagactttttagtaaagaaactaaacacaaagtcattagactctgtaaaagtcttaccaaatttgattc

SEQ ID NO: 733 - DNA, 201 bp, Homo sapiens
gccagagatcagagcaggctaagggactgctgggatcctgtccagctttgagaccctacagagccatgttcacctagcacgtatcccgtctgcggtcacgstcatttcttaccttattccagggctttcacctcagcttgccaggctggagccaagggccaacgcagccgcgccttgttcgcgatggtagcttcccaggag

SEQ ID NO: 734 - DNA, 201 bp, Homo sapiens
tacagaaaatgtccagggaaatggtctatttcttattctatttttgacctaaagaaaatctttaaaatgtcttagcattttccccagtctccatccacttycctcagctttggcctgaagctatctttaaaggtaccctgtacagctcttgccctgtacagctagctacagagattcaatcctttctgttcgattaggaca

SEQ ID NO: 735 - DNA, 201 bp, Homo sapiens
gccacagtaggccagtgacaagggaagattgacacatcatcccctgctggggcccagtgtcctgtggctggcaggcaggggatcctaaggacatgtgggtsttaaattgtagggtgcacttcctgggcacctttgagggtctgcactgccccagcaaatatccccatgctagaaggagcaaaatattaaatggcaaatttt

SEQ ID NO: 736 - DNA, 201 bp, Homo sapiens
gataaatacatcaatggcacaaagaatagatagagaaactggaagtagacccaaaacaatatggttaactgacttacgaaaaaatttcagaagccattcartcgaggaaggatagggtggtattgttgttttttgttttaacaaattgtgctggataaattggacatacctatggaaaaaaaaatgaagtttgacttaaac

SEQ ID NO: 737 - DNA, 201 bp, Homo sapiens
taaagtgaacagctgcaatgaaaataagggaagaaagtttagttcatctccgtttctttcctttcctttttactttcctttctcttcctttttggagttartcaggaagtagtcccaaataccccagaaagttcatcttataagcccttggtcctcttgagatggtatcagatatattgctagacccttgaagaaaggaac

SEQ ID NO: 738 - DNA, 201 bp, Homo sapiens
attcaatcgaggaaggatagggtggtattgttgttttttgttttaacaaattgtgctggataaattggacatacctatggaaaaaaaaatgaagtttgacytaaacatcatactttacacaaatattaactcaaaatggagcatgggcataaatctaaaacttcaaactgtaaaacatttagaaaaaaataggaaaaaaat

SEQ ID NO: 739 - DNA, 201 bp, Homo sapiens
acagtggtctgaatccacctgagacagaattgggtctaactaactgtgagtatggccttcaataagtcactctccatttgggaatttgatttctccacttstataatgagagtatttgacaggatgctctcccaaatcccttgcaattttgttagtctgtgatttcatgtttttatttttattccttcatccaacaaatag

SEQ ID NO: 740 - DNA, 201 bp, Homo sapiens
actgaacatgtacagactcttttatctttcattattccctaaacaatacagcataacaactatttacatagcatttacattgtattagctattaagagaawcctagagatgatttaaagtacaaaggaggatgtgtttaggttatatgcaaatagtaagccatttttatatcggagacttgagcatccacagatcttgata

SEQ ID NO: 741 - DNA, 201 bp, Homo sapiens
gaagtgatgatgagaaattacctaatgggtacaatgtgcattatttgggtgatggatacgataaaagccctgactacactactatgcaatatatctatgtracaaaattattcttgtaccccataaatttatacaaattttttaaaattgtaaaagaaaaaacaatatgtcaggaaatcaggggaaggtgaaaataatggt

SEQ ID NO: 742 - DNA, 201 bp, Homo sapiens
gttctaatacttactaaataataagcattttcctcagtgaaagtctgttgagtgaaaccaggttgatttctgactagacccaaaacaaaatcactgacctratttctcttcaagtcaagtatttcttctgctctcctacactttccacaatgtattatgaaatttttctcttaagagaatgtaaacgcttagatgtcaggg

SEQ ID NO: 743 - DNA, 201 bp, Homo sapiens
ggatttctctactgaggttagaatctctgccattagagactgataaatttaaagtttgcaattatcaaactggtgacaatttaagccagaatcaggtaaaygtcctcagttttaacagcattggaattttctgggactagctgtgtatctatccaggattcttgagaatgcctgccatttttcaacataatggatgtaagg

SEQ ID NO: 744 - DNA, 201 bp, Homo sapiens
tgagatggagaaaatattcattgtcgactgtaattatgcaacgaatatccagttgagataatggacttgcctcttatctaataatacccaggctcaatgcrtcactgctttgtccactttgcccaaaattcaagcacagctaagttgatattttaggacaaaggcagcttactatccagccagaggggagtagaatatggt

SEQ ID NO: 745 - DNA, 201 bp, Homo sapiens
tggaattttgaaattaaaacagttctgtaaaaccagtttagttttgtaaagtgtatgcatcaaagatgtccttcattcagacattactgagttacaactayggtgccaggtactgtgtcagggtactaggggtatggggataaaccagactccctctttgatctaaagcagcatgaggccaggtgagaggtttcaatataa

SEQ ID NO: 746 - DNA, 201 bp, Homo sapiens
tcatagagggtaaaagtcaaagagcagagaaccaaaaattgggctaaatcttcaattcacaatacacatggccttaaacttctgcttcagaagagatttgyacatcaaggttggctcttcacactagcagagatacggaatcagcctccaaattgtcactgctgacatgacatttaatggtggggaaaaacccaagtgtcc

SEQ ID NO: 747 - DNA, 201 bp, Homo sapiens
catagagtgaacagactcttaagaaacaaaagttgttctcatttactctcaccgccaggcacacacttaagggttcttcaattacctcactggtctctctyttaagtgacctctgctagctcttccttatctccttgaactttaagtgttagagggcaccagggccttgtttttggacattttcccttctctatgctcact

SEQ ID NO: 748 - DNA, 201 bp, Homo sapiens
tttcccttctctatgctcactcccttggtgatctcatctgtgtcattgctttaatttccatctacatagacacaacttctaaatgtttgtgcgtgtgtggraagggggatgtgatcttttgaggcccagatatatgcatcaaactgcctcctcaatatctccttttggatatcaataggtgcctcaaatttaacatatcca

SEQ ID NO: 749 - DNA, 201 bp, Homo sapiens
agaaacactctaactgccctcttaccagcaagagacagggctccactctgtgcagaactttcacaagctgcccctactacaacacgcaacgtgctcagtgwtcataacttcccaccctcactcactctgtacctttttcctcactctgatttctttcatccactgaccatcaaccatttcatctctaaatcactcccttag

SEQ ID NO: 750 - DNA, 201 bp, Homo sapiens
aggcttgagtagcagggcactaaagaagcaagccactccccctgtcaaccaccctgcgagagggacaagggagctttttccttttcacctctctctgtttytcatcccacttcttgcattatcccagtggtagtttcttttaagatcaatctccactattgccctaaattaatgttccctccataagtcttctttatcagt

SEQ ID NO: 751 - DNA, 201 bp, Homo sapiens
ggatggctgagccaaatctgggaggataagtctaacaccatttcttcgtaatagctcagttgttccaataccattttcttctcaacctccaaaatacaggktactttatttatttcagtattctttgtgcatttaaccaccattctcattccacaggctttggtgaattaaagtaactacagttaccaactctttttattg

SEQ ID NO: 752 - DNA, 201 bp, Homo sapiens
ccaataccattttcttctcaacctccaaaatacaggttactttatttatttcagtattctttgtgcatttaaccaccattctcattccacaggctttggtraattaaagtaactacagttaccaactctttttattgaaaaactctttatgagttgattgtaactgcttctccaattataattgcttcctctccacaggcc

SEQ ID NO: 753 - DNA, 201 bp, Homo sapiens
caatggcctcaggatgaggagtggcaatgacacacagcacctaaagatcactggtccatcaacaaaaggaaggaaatgaggctggcatggtaggcagtgtmaggttaccaacaagcctcttccactaagcaaatagaaacaacaaaatatctgcaaattctctacctgtgatgtttgggaaatatcttcagtgacctggga

SEQ ID NO: 754 - DNA, 201 bp, Homo sapiens
gaacatgcaatgttagtcttcctgtgcctggcttatttcccttaacataatgatcacctcttgccagcatttgaggtagggagagtgtaggcacttatggraacctattgcagtaggatctaccctagttttattttacatttccaactgccttttggcagtatctccattcaaatgtttaaccaccattgtaaacccaac

SEQ ID NO: 755 - DNA, 201 bp, Homo sapiens
ctagttctgtgagtgatcctatgtatctagtcacccaggcttacaaatttgctgtcacgtttgtttcctctctaccttatttccaacattcagtgagttayctagtatgatggttaattttaggtgtcatctggattaaggaatacccagataactggtaaagtgtgtctgtgagggtgtttccaaaggagactgactcat

SEQ ID NO: 756 - DNA, 201 bp, Homo sapiens
ctatatctgatctatatcatctatatctacatcctatctgttctatcttcatgaaaaaccctgacaccaagtcagaaccaatttagctctccaatatgtcrctcagtcctgtcgcctctgttctctttccactgccaccagagtaagtcaggctcacatcatctctacctagaccagtgcagtggcctaactacctttcgc

SEQ ID NO: 757 - DNA, 201 bp, Homo sapiens
tattagatttgggtggggacacacatccaaactatatcactgaggaagcccattcttgtgaacgtccagcttacgttttgaaactacaagagaagtagacmgttccaatgtacttatatttgtgatttccaggtttactgccacataattttggcccataaagtgaatactctttctgatttgggattgtgcattcataaa

SEQ ID NO: 758 - DNA, 201 bp, Homo sapiens
acgtaagaggtgttcaatgttagactacttccttctctccctgtaagttagtacaaaaagggcaaatgaatgagtttatatgttaccttatcatgctttamatctaaacatttcaccaaaattcataggaagaaatatagtaaagaaataaactgaaaaatcaagccatcttggaagaaagctgaaaggatatttttatct

SEQ ID NO: 759 - DNA, 201 bp, Homo sapiens
ggatctgataattaaattggaattatggcccagaaaattaggccaggacctgtgtgttaaccctaaaaagggttactgcccgctaaataggatccagagtytgctaacacactttacaaaatgtccagaatacacataacaaccacctttcatatcaagacgcaggaaaatcacaattgtaataaacagagatagtcaagg

SEQ ID NO: 760 - DNA, 201 bp, Homo sapiens
taaggtcacattcataggttctgggggttaggatgtaaacatatattttgggggccaccattcaacccattacatagtgtttatgtgggggagagatatcytccctttttgtcttcctgattgtaatgttaatatacgttcatcataaaaatatagtgaatatagaaaatcacaaagaaacttaaaactcatctttaattt

SEQ ID NO: 761 - DNA, 201 bp, Homo sapiens
tgaaaaatggccaaacataaatcttttaccctcaatttatgtcatagcaatcgataaccagggtggctggctgacttgtaattggctgtattctacccaawatgtctcttgattctagaatgcagggttacagcaactacttttacaagaccctgagatacatattgaaaaccagctacctatataacactagtttctaat

SEQ ID NO: 762 - DNA, 201 bp, Homo sapiens
aaggacttatagatactgtgtcacttattcattcattcatttattcataaataacttattaaatgttagacaacccaaaataagcaaagcagaaaacgttyctacattcgcgtagcttaaaattgagtgtgagagacagctatttaaacattatcatactacttctgcttccaagtagaatgtaataagtcacagtaaata

SEQ ID NO: 763 - DNA, 201 bp, Homo sapiens
gacacttctgctgtaataattacttaaatatgaataaattataaaaatggtatttagatgcctgagagagctttgataacaattaggactagatgaattawatttccatagagtagacaaccattccaagccctgcaccacaaaaaaatataaaaggaatccttgagacagaaaaaaaaagataccagacaggaaaatgga

SEQ ID NO: 764 - DNA, 201 bp, Homo sapiens
tactaagcttagatttgttttctcacatattctttcggagcttgtgtagtttccacattaatttaccagaaacaagatacacatctctctttgaggagtgycctaacttcccatcattttgtccaattaaatgaattgaagaaatttaatgtttctaaactagaccaacaaagaataatagttgtatgacaagtaaataag

SEQ ID NO: 765 - DNA, 201 bp, Homo sapiens
ctgccaggattccaggttccggtactaccaggtctagggctcccagggttttggtttccagtacttccagttccagagctcccagagttccagcttccagyacttccaggtccagagctcccaggtttccaggttgcagtccctccagtcccagagctcccagggtttcggtttccagtacttccaggtccagagctccca

SEQ ID NO: 766 - DNA, 201 bp, Homo sapiens
ggtttttccacgcagtaccttataactcctggacaatgtgcatttgggaaggtatttgtttattctgtgtcttgcctacacaaagcttcctgaggccaagrcacaaggactggcacaaatgtcaggcatagagcaattgctgctcagtatctgctggagaaatggaaggctgtcaccatatggtggtgacaatgcatggtg

SEQ ID NO: 767 - DNA, 201 bp, Homo sapiens
aaagacaaggcacatggacaggcagttcacagaaagaccactgacattgtggctgatatgtaaattgaaaagattctcagtgtgctcatgatgaaagaaawtttaatcacaataacaataagataacatatttcacctaataggttggcaaaaaattttaaaatttgacaacaacaagtgatgacaaggatgagggacaac

SEQ ID NO: 768 - DNA, 201 bp, Homo sapiens
ggcttcgccaaggtctccccggcccccagcaaactacctgctatgaagtagatgctctgtaaatagttgttaagcacaaattgccttgtgctatggagacygggcctgacatgagttgtaaaagtatcaacaagtgtattgacaatgggtatcggcaagtctttgcccttcaagccagagagctgctgggcaggacagatt

SEQ ID NO: 769 - DNA, 201 bp, Homo sapiens
actttactggacatcctgtactttatctggcaatcctaccttgcctcaaattctgcttcctacatgaagccaatcctaatagagtaatagctaatgtgtaytgaatgtttactaagtcttgggttctttgctagacattttgcagggtacctgattcaatgtccaattaaaaggaatctcatgttctttcatacttcctta

SEQ ID NO: 770 - DNA, 201 bp, Homo sapiens
attgtaagctttggaggagtaggttttgtttagctggaaaaccatgcaaattaataggcatgatacgagtatcattttttaaaaagcatgtgacaataagsgtatctttaaatgtgcaaaactggaaaaaagatggaagaaattttcagttgcttaaattataatctgccgtgcattggctttttctttttgagatggagt

SEQ ID NO: 771 - DNA, 201 bp, Homo sapiens
tgttaatgcctggaaagactttgggaataattagattgtactatcagttataaactgtcagttataaatatcttagcaaggtgtatgtgtgtgtgtgagaragagagagagagtcctcgggtcttacttatcacaatttcaccatcctctactacatgaagccccatctcatgtgtattagtttgctagggctgatgtaac

SEQ ID NO: 772 - DNA, 201 bp, Homo sapiens
tttccttttcattctgctttcaaaccacaaattcatgtgtggatagatcttaaaaacacaatgctgaaataaaaaagtagtaagtatgatgaagacttcarcagtgattgtcaaaggatttgtggtgaaggactagttttattaaaattctaatcagccacagaccaggtttttatagaattcaataaaaataattactaa

SEQ ID NO: 773 - DNA, 201 bp, Homo sapiens
ccaccacacttaggaccaggcagacgatcctcatggaaaacatcttttctaagggtggggctggctcctgaggagcactccagctgaaagaaaggattgcygccactcctagttcccatcctatttaaatctgcaagaggtttggttaatcattggctttgtcctgtgtagacagtcaaccctccctctacgtcctttgtt

SEQ ID NO: 774 - DNA, 201 bp, Homo sapiens
tttcatgcactgtataaggaaggagccaaccttatgaaacagaattcctaaaatgcagagaccacacacatgcacagaaccacagagtgaggtctttttayacacacacacacaaaaacatgatgaaaatctcataactataatcccagtgctttgggaggccaaggcaagaggccaggagtttgagcctccagtgagcta

SEQ ID NO: 775 - DNA, 201 bp, Homo sapiens
atacacattatatatacatatacatacatatgaaacctttgctgttagatatgtcagataatacagaatgagtggtaatcatttaacacatttcatgttcygtggtgccagaaatgggtaggctgtctagtaaatagattttgttaattagtacattctgtgatataatctagttgtgctgaatttcctgagatgcttgga

SEQ ID NO: 776 - DNA, 201 bp, Homo sapiens
ggaggaggatgagatggtagcaggagaggctggatgtaagaaagggaacaggaagtgggtgattgcccttatcctggcaagagatgtatctcaactacaawggtgacaatcggtatacaggaaaaaagtgaatatgataaatatataggaggtgaattcagcaggcttgatgagtaattggatatagggaggtagaaattg

SEQ ID NO: 777 - DNA, 201 bp, Homo sapiens
ataacatttagcataaaatgaggactcaattactactgatggttgcccaattgtaattggtaaattggcaaaaagtggtggtttttaatggtcaataaagrtaccatgtatctagtcttaggaaacaaaaggtttattgaaatgcatgtagataaattatcatcagcataaaactgttatggagttttcaacatggggtct

SEQ ID NO: 778 - DNA, 201 bp, Homo sapiens
ctcatccaacccccatcctaaaataagtgtctactgtcctcagactggtctcttctctcaagctttcacaaacccctgcccttaccagtgcttgccttctytttattctgttcctccaaacacctgttcactgcgtgtatctgacacaaagctcatgggaagccaggttaatgtgtcaacaagcatccatgtagtaatgtt

SEQ ID NO: 779 - DNA, 201 bp, Homo sapiens
aagtcagttgaattaaacatttaagtattagtattctttcaaacagctctacctcagatagcatttgtagcaaccttatattatatgtatacatgctgtawccactgcattagattgtaaactgatttctgtggctacggcatctaacatatatagctgtacttaacatagttgtagttaacactcaataactatgtaatg

SEQ ID NO: 780 - DNA, 201 bp, Homo sapiens
cctgtgctcttaaccatgaatcttaatacaaccatgaagcccttcttaatttaaaataatacacagatacaaggtgttatgagactcaaagttattcactratagaatggattttaaagatgtgtgtgtgcatctacataactgtgtgcatgattatttgaacacacatttacatctatctaccaacttatctatcttctt

SEQ ID NO: 781 - DNA, 201 bp, Homo sapiens
gcaaacctgttaaagtgcttccaaaatagagctcattgtgtgctactcccacttcattattatgtttttttccttgatcagcctcaaaatcccttgaaaawctcattctatcaggtgagaaaggcctcacctcagcagggagaaagaaatgaatgtcataaactctggtaactctggtttttcatatggtcatggccctaa

SEQ ID NO: 782 - DNA, 201 bp, Homo sapiens; identical to SEQ ID NO: 770

SEQ ID NO: 783 - DNA, 201 bp, Homo sapiens; identical to SEQ ID NO: 772

SEQ ID NO: 784 - DNA, 201 bp, Homo sapiens
gctaaatgtccttaatagaagacttgaaatcaataaatatagtaagagaaaaaaggaagaaactttcagagaatttctgaaactttgtgggtcaatagaarttagcagttaattttctacaaatcatcctcagggtaaagtgagtcatattctgtttccgcagggtgctctggtctgacctgtttggctccccccaggtgg

SEQ ID NO: 785 - DNA, 201 bp, Homo sapiens
cctaaccaaacagtacaactttaacaaaggtcagtcaaatcctagaagatagggaaatgagggagtttatagcattgtgttgtgcatattctctagaataygcagaactagggctagaatgtgtcatagagaaagccaagtaaccttcacctggccctttccttaggtttgtctgtcttggtcccatgctttagctcagct

SEQ ID NO: 786 - DNA, 201 bp, Homo sapiens
agactaaggaatgatctgaggtgccctggattgagacaaattgaacagagaagttggatttaagtgttttgctgtgccacattggtatctgctactggttkgtttgtgtttttccatctttgtgtaatctacgattttaaatctctcaccccatgaaagaattttcatgactaaatatgattagcaggagatttacaagag

SEQ ID NO: 787 - DNA, 201 bp, Homo sapiens
gtaataaacaaggaaaatacctgggaatttgaaactctaaaatgttctcctattttattaagtacatactaaaatatttgatataatgaaaataatttacraagacaaaataaatgacaagtggtcataaaaatgcaaataaagtcaatcattttattattatatatttaggaacaaagttgaaatgttatctcctcaaat

SEQ ID NO: 788 - DNA, 201 bp, Homo sapiens
cattagacaatctcaaatcttgtatacttcctctttgttagagtatttaatactgaagatatgccataatcatttcttgttgcaaaaagaatttaaaaacyaacggtatcagtttttttctattgaagtttaaaattagattttggtaattcagaaacaaaaagacaaatacagcatgttctcagttataagtgggagcta

SEQ ID NO: 789 - DNA, 201 bp, Homo sapiens
aggaccctgcatagatttctaggcactggagcgtcctctggaacgccctgtgagacggaaggtggcacgcacctgctccttgaggctgttcaccttctccytctccttctctagtgaggcctgcagggcctggacaagatgcttcatctggcgatcctcctcttctttgcgctgcaaaactgcctgcacctagatcagatt

SEQ ID NO: 790 - DNA, 201 bp, Homo sapiens
taaaagcctacaggcttagataatggaagagagagctccgtcctcacactcctttctgctgagcatgaaatgcctggttactcaccagttgtgaagacttygtttgtgaatgagacggtcagttcagcggtggcttctgagaattctaagaaagcaaaacaatgttaggtcttccccgtggttccctatatcctctagata

SEQ ID NO: 791 - DNA, 201 bp, Homo sapiens
acgcacgtggttgttggtgtgattctgtttctccagattgtctccattcctccctggcttctccacagggccgctcaccatggcagccggctccatcaccrccagccagcgagagggcaagacaagagggctgacgagggacgctaccatcacagaggtcagttttgtaacctaaccacaagactaacctactgtcacttc

SEQ ID NO: 792 - DNA, 201 bp, Homo sapiens
aaacgctcctccttctgaaccccagagctccactctgcacccatgctctagcctcacaccaaggactttcttggtaagagacggacagttcggtgaagtgrttaaaagcctacaggcttagataatggaagagagagctccgtcctcacactcctttctgctgagcatgaaatgcctggttactcaccagttgtgaagact

SEQ ID NO: 793 - DNA, 201 bp, Homo sapiens
attaaatcgagaagtctaggcagagaggagagagagaaggggtccgtgtacctcatacgctgtgcaccagaatggaccctgcagaacctacctgctaccgrggaaggtggttctgttggtaaccggctgggggtcacagaggttcctgggaaatcagaaaatgagataaatctgtgctctgtcgctgtgggtcctgaacaa

SEQ ID NO: 794 - DNA, 201 bp, Homo sapiens
ctctgagacacagggaatgttagacacgcccagcctccagcctagcgtatgatattcttaaagtgcaggccgtagtctggtacaccgtattcagctgagaygtttgtgaaagtggaggggataacacgcctcacacaaaacttaccgcagtggttctcaaagcagcattctggagccatagcatcagcatcacctgggaac

SEQ ID NO: 795 - DNA, 201 bp, Homo sapiens
tcagctccacggcctcttcctctgagacacggttttctcatccgccagcagggctctgcctgcttcccggggctgttagaggctggcaggccaggtcaacrgaggaaagggacctgtgctctgtgcctcagaagacgtaggcgaggagcaggcatgaggcctcagggacggtctctgagggagggtcctgggccctgggct

SEQ ID NO: 796 - DNA, 201 bp, Homo sapiens
agctctcttcctcttggtcagccccagtcctcaccctaccccatttctcctttaataacatcttattaaatgcacctggcaccagcctcaggttaaggatytttttttggccaggcgaggtggctcaggcctgtaatcccagcactttgggaggccgaggcgggcggattacctggggtcgggagttccagaccagcctgg

SEQ ID NO: 797 - DNA, 201 bp, Homo sapiens
ctgactccagctctttccttcttgggatgctgctgcctcttcctcttacctctgctgcttgagccagtgtgtgctctgctctctgcttccctagccccgcyatccttctcatcccttacatccaagatgtcctcctcctcttgatgctgctgtcttttcttcttgcttttcctgcttcttccatcactgcatgctctgctc

SEQ ID NO: 798 - DNA, 201 bp, Homo sapiens
gtgtgccagaacttgtccctttggtactgggggataaaaagacgcataagacacaggtcttgatttaggggaacacccagtctagcctgggaaacttgggrccttgagtgggattagatggaggacatgccagtgggacttggagaaagatacaggatgggtgagacgcggtggctcatgcctgtaatcccagcactttgg

SEQ ID NO: 799 - DNA, 201 bp, Homo sapiens
attcttgattcctgctctttcttatgtccttccttttgcttactgtgggttttatttgtttttgctcttctttctgttcttgctgttctgagcaaagaagkctactagctgttgttttttaaaacgtttttgcagatagataaatcttaccgagaagatgtgtatgatctctttcctgggacattccaaaccattgaactg

SEQ ID NO: 800 - DNA, 201 bp, Homo sapiens
tagtccaaggttacaagtgccccatggcaaccaggtcacagaccctatggtcccagatgctcatttccaacagagtcccctcttgtgccaatggaaagcayggagtagtacatttcagtgtcatcttctacaaaaggttttgctgtaactgaatatgaatattgtttccaaacttcttagtagacaatataaaggggaaat

SEQ ID NO: 801 - DNA, 201 bp, Homo sapiens
ttaaaaggctaccataactaaagaaataattgtataataactttgtcatgtgtacaatcttagcccatgaatgtataaaaatatagcctttatgatgttcwtacaactaatatgaactcctactttaagtctccatcccacggggctagcaggaaggtctagcttcagtcttctgagactccctcccaagtgacataagga

SEQ ID NO: 802 - DNA, 201 bp, Homo sapiens
cttacccaaggcccctctaataaatgaaggaagcagaatttaaacccattgctaaagactacatgatatttaatactacacaatgttgctctctaaagtgragtagagttatatatgcctttctcggaaaaacaactaaagccaaactattttatttgactaactactgcctatatttaaattacactaatgttgaaagag

SEQ ID NO: 803 - DNA, 201 bp, Homo sapiens
ctgtctctatagttttgccttttttgaaaggttatgtggaaatcataggttgtagcatcttgaatctggcttgtttgatttaacataggcattcaaattgyatccatcttgttatgtgtatcagtggtttgtttcttgtgactgttgagtagtattccattgtaaggatataatgcagtttgtttatctattctcctgttg

SEQ ID NO: 804 - DNA, 201 bp, Homo sapiens
tcaacaaatgttaaattctatcaaatggtttttctgcatctattgagatgatcagatgctttttcttctttaatctgttgctgaattacatttattgattktggagtttttaaacactttttcattcccaggataaaccttacttggtcatgatgtattattcctttttgtggaattgatttgctagtattttgttatgga

SEQ ID NO: 805 - DNA, 201 bp, Homo sapiens
ttttcttcttcatgctaccttgtctaagatcctctttgttcttagaggagacaattcctcaactattgaagtgccatgatcaatacataaaaaataggctkcctggaaaaaacaaatgtaggggacagtctttccaagtctgtcttcaaaggtatcttctctgtggtttcatataaagacccttcctcatgtgtcctcatc

SEQ ID NO: 806 - DNA, 201 bp, Homo sapiens
gcctacttgctaaaatttatttttaaccccaaaatcaattcctgtgacatttttgtggtcatttgcaggtacatgtagagtggcaaaaaatttacgttgcytgatgcacacattttcagctgaggtcaaacaaggagtctctctgccttcttgtttcagctctcatactgtaaacaaatgtccttgttttcagattattta

SEQ ID NO: 807 - DNA, 201 bp, Homo sapiens; identical to SEQ ID NO: 325

SEQ ID NO: 808 - DNA, 201 bp, Homo sapiens
agctattctagatgtttgccttcccagataaattttagaaataatttgttgattttgatttttaaaatcctgttgggattttgattggtattgcactgaakctatacaatgggttggacagaactgacataacaatattgaggcttccaatccatgaacatggtatatctatcgtttagctcttctttgatttctttcatc

SEQ ID NO: 809 - DNA, 201 bp, Homo sapiens
tcaccatatttagtgtacagttctcttttgataagcacatacagtagtgtaacgaacaacaatcacaatatagaatacttttatttcccccacaaattttmccattgcaccctctagtgtcaactacttccccatacttaacacttgtcaaccactgtctctatagttttgccttttttgaaaggttatgtggaaatcata

SEQ ID NO: 810 - DNA, 201 bp, Homo sapiens
gcaggaggggaaaagtgctaattaccatgacaagaacattgtattacttaaaaacaaggcagtgctaatgcctaatggtgctacagtttctgcctcttccrtggaacacacacatggtgaactcctggaaaaaacactgtctcaatattatccagattgtgtttccattgcggtgcagaaaaccacatctcacataaatgc

SEQ ID NO: 811 - DNA, 201 bp, Homo sapiens
agaagaattctgaaatatacaaggacaaagcaggatgtacgtctttagtgtctgccgctgcaaaataaacacgagataactaacgtgcgtgaattgaatgkttgcttctcacccatattttatagaaacagctatggggaagaatattggtgctcaaagtaatgatgattccgagtatgtccgtgcagtttataggtaaat

SEQ ID NO: 812 - DNA, 201 bp, Homo sapiens
ggagaaaatgtgtcctatgtatttccttcccagttctttgaaagagagtgataggaaaaaggaacactattgaaggaaggactgcccagtttcaaacaggwatttatttttctctcctaggcttcccctgcaggatgtttggcgcatctatagtggcattttaaatctgtcagacattacaaaagatacacctttctcaca

SEQ ID NO: 813 - DNA, 201 bp, Homo sapiens
gcttgccatcgagacatttataaaggagttgatatgagaggagtcaattttaatgtgtctaaggttagcagtgttgaagaatgccaaaaaaggtgcaccartaacattcgctgccagtttttttcatatgccacgcaaacatttcacaaggcagagtaccggtgagtacaattcaaggtgtgtgttctttgtattggtgcc

SEQ ID NO: 814 - DNA, 201 bp, Homo sapiens; identical to SEQ ID NO: 700

SEQ ID NO: 815 - DNA, 201 bp, Homo sapiens; identical to SEQ ID NO: 701

SEQ ID NO: 816 - DNA, 201 bp, Homo sapiens; identical to SEQ ID NO: 702

SEQ ID NO: 817 - DNA, 201 bp, Homo sapiens
aatgagtgagatgatatttcgaagaataaagatgccctggctttggcttgatctctggtaccttatgtttaaagaaggatgggaacacaaaaagagccttmagatcctacatacttttaccaacagtgtaagtccctgacttttacaattgtggtaaaatagacataacataaaatttccctttataaccattttaactgt

SEQ ID NO: 818 - DNA, 201 bp, Homo sapiens; identical to SEQ ID NO: 703

SEQ ID NO: 819 - DNA, 201 bp, Homo sapiens
cctctaacagtaacatattacagaattagtatattcatcaaaatgagaaaacaaacctttgtccaatactggtcacaactttctcatcttgattgaatttmaaatttgatgtttttccccagaattttttcagcagatcattgagtacacagaggaataccgccacatgccgctgctgaagctctgggtcgggccagtgcc

SEQ ID NO: 820 - DNA, 201 bp, Homo sapiens
cttagaaaaataaatgaaagaaactagcatattttataagaaaatgtgttaactagggtgcatccaagtccaaacagaagcatgtgattatcattcaaatyatacaggtcatcgctgaacgggccaatgaaatgaacgccaatgaagactgtagaggtgatggcaggggctctgccccctccaaaaataaacgcagggcct

SEQ ID NO: 821 - DNA, 201 bp, Homo sapiens
actagggtgcatccaagtccaaacagaagcatgtgattatcattcaaatcatacaggtcatcgctgaacgggccaatgaaatgaacgccaatgaagactgyagaggtgatggcaggggctctgccccctccaaaaataaacgcagggcctttcttgacttgcttttaagtgtgactgatgacgaagggaacaggctaagtc

SEQ ID NO: 822 - DNA, 201 bp, Homo sapiens
ccctttataatgcagaaaatgtggaggtgggtacatgtgaatatgatcagtattgtactgtgtatctgacagtgtgagaatctcaccagaatcaatataaygtgtccttatatttcagccatttcagcacaaaaaacattccactaagtattttagactatataggtgcaatttaatgctttccaggtatagcccgaatcc

SEQ ID NO: 823 - DNA, 201 bp, Homo sapiens
agttatgacaagaataatcattatagtacttttcagattttataacctggagcagattattttaagttgattagtaggttctgttacagtttttcttttgwtcgtgcacttatagtcttcatttaattcctcatagaatcccagtcacctttatatatcatattattggaagagattcatcttcataatctccagtttttt

SEQ ID NO: 824 - DNA, 201 bp, Homo sapiens; identical to SEQ ID NO: 709

SEQ ID NO: 825 - DNA, 201 bp, Homo sapiens
taaagcggggatggtattcacaacatttaacttatagggtccaagcactgaccaacctgaccattagaacagagtgtggtctctgtacagggcagatggcrctgagtgggtattctccacagaaagagaaacgaagacagtaccccactcctccaacccaccacccaccaccaatcccaccaccaattccaccaccaatcc

SEQ ID NO: 826 - DNA, 201 bp, Homo sapiens; identical to SEQ ID NO: 329

SEQ ID NO: 827 - DNA, 201 bp, Homo sapiens
ctcaagttgctcagggtctcatatcaatgataaacttagtccaaatttaaaagacaatgcaaatttgatatttatgggataaatattacaaacccatgctrttgaaattagtcctccaaaaagctgtagtctttttacttgttgaaaggtctggggaaatcatcttgtagtatggtgagaaaaggatttgggtcaggaaac

SEQ ID NO: 828 - DNA, 201 bp, Homo sapiens; identical to SEQ ID NO: 715

SEQ ID NO: 829 - DNA, 201 bp, Homo sapiens
atgggtgccaacttggagcctggggttgctggggctaacgtggaggctagatagagtcttgggggccaggctagagctggagcaggcctgaagtctaggtyttgtgtggccatcttggagcctgaagccccaggggctgacctggtctggggtgagcatggggctgaggccacagaggctggtctggcctgtggcaggcct

SEQ ID NO: 830 - DNA, 201 bp, Homo sapiens; identical to SEQ ID NO: 717

SEQ ID NO: 831 - DNA, 201 bp, Homo sapiens
ttgaaggatctatgatcagctgcttcaccgccatgtgactttatgaatagagacgtgttaaagcggggatggtattcacaacatttaacttatagggtccragcactgaccaacctgaccattagaacagagtgtggtctctgtacagggcagatggcgctgagtgggtattctccacagaaagagaaacgaagacagtac

SEQ ID NO: 832 - DNA, 201 bp, Homo sapiens; identical to SEQ ID NO: 719

SEQ ID NO: 833 - DNA, 201 bp, Homo sapiens
gtccacagagagatgaaacagctgcaaccgcttctccctcaaggtgggatcatcaacgggcagagctcctactgtgcccaccaccttctcttcagattcasccacccagaagcaggagccacactcactcaggtaggatttggtgatgtcagacatgtctgtgcgcaatgctatgtctacataccgcgtccagggtttttt

SEQ ID NO: 834 - DNA, 201 bp, Homo sapiens
gagctggggtctcctgccgagtctgagaagattcaacctccccagaagactcagaaggctgagctggctgctcctgctcactaatggaaagttcacgctcygtaggatgacatggaggctcggttggggcctactgttgggttgcagaaggttccacctcctctggaaactgaactggagcctcctgctgggcttgggaag

SEQ ID NO: 835 - DNA, 201 bp, Homo sapiens
aaaataattttgaatgatacttcaattaatccttttatattttatagttgcaagtagaatatggaaaatgtcaactacaaatgaaagagctgatgaaaaartttaaagaaatacagacacaggtagagtataaatgaaaacataaaaaacaaattaccaggcacagtgactcacaccagtaatttcagcactttgagaggc

SEQ ID NO: 836 - DNA, 201 bp, Homo sapiens
agtggggaaataattaggtagctatagtggggtcctgaaacaaatcgaaatggcaagaatgggaataaatgggagaaatatttcagaggtagcatcagtaratcagtagtctgttagggaatgttagtgctactccaagaaattagagaaatgaggaggtgagcagatatggatggaaagatgatctcttgttttggactt

SEQ ID NO: 837 - DNA, 201 bp, Homo sapiens
gaaggtgaggaaaagtgaaaaagacccattttccaagagattctgatacatttttcttcctcctctccttcctctccttccaggagaatcactggcctatrtgatttcaagagtgtaatctcacgtatcactaaggtgctgatgagtcccaaatcataatacctaccatgccttttctgtatgacatttccagctgttgga

SEQ ID NO: 838 - DNA, 201 bp, Homo sapiens
cacattggtaagctttgagaaaaacccagaatcgtatatagaaaaccttcccccgagctaagagggagccaggagaccaaaggatgactcacaagtccagsttggtgaatagatacatttactaggactaataagtttatttattacaaggcactcctggatggcagcaggacagctgtagagatccatgctgccctttgt

SEQ ID NO: 839 - DNA, 201 bp, Homo sapiens
gggaggggctgacgcgcccgcgtggactcgcacagcaagatcctggacgcccgggatgtggatcagcgcaagcaccaccttcgagaagtctctgcggatcrgcagggagtttcagcaccgcgccaaaggccggatgctgagggtagctgtgctgcgcaaccagatccacgtgaaatcccttccagagaagggagcccgggg

SEQ ID NO: 840 - DNA, 201 bp, Homo sapiens
ttttcgcacctatcaatgctcaggctgagctcctgaggctagacctaccggcaccccccattcctacaggttctataaggcaagtcaggtattccaccctstaaaaagctcttctctctcctgccccgctagactagtatcccctccttaaggctcccaacatccgaagctaagttgtttgtctgcctatcatccaggaac

SEQ ID NO: 841 - DNA, 201 bp, Homo sapiens
tttgttagtattggtctagaaaggcctttgagggctgatttagccctagagtgtggcccttctgggttccacactaattatgccagtattcaacttggtckttccactccaactagtaggagttgaacatctcctacacagaaaaactccagtagttattctttgcatagctcacgaaatttccctaagaagacacagctt

SEQ ID NO: 842 - DNA, 201 bp, Homo sapiens
cagtggttttgtagtgctagggctctccaacatggggcttgtccccttccctctctttgaacccttaataccaactagagggttggccatcagtccttctscagtgcatactctcactcagaagatctcataccaccaggtaagtgagttcacaaacaatatgataaccgaaagatactactggttcaaaagaaaactgga

SEQ ID NO: 843 - DNA, 201 bp, Homo sapiens
ctgccttctcacagcaagtactagaacggtgaaccatatctctgctgcaggtgtcctcacagataaaattagagtagcacaagagctttttgggtgaagckttggagaaaacaggtgtaaggattgattagcttgggcattacttcttcacccttcagccttcagactcacagaacttctcagttaataatctaggcccta

SEQ ID NO: 844 - DNA, 201 bp, Homo sapiens
ttctttcagttgtcattacccttttagtttttgcctgctttaggttgttctctagctctttagatagcttcacatattttatttagtgtcaacagtagttrcctgcaggaggattggtttcatagaaactactctgctataactggaattggaactctttcagtagaatatatatatatgagacaggatctcgcactgtca

SEQ ID NO: 845 - DNA, 201 bp, Homo sapiens
tctagcctgggcaacagagtgagactctgtctcaaaaacacaaaacaaaacaaaaaacaaattaaaaaaacagaaatgtgttgtctcacaattctaaagtytggaagtccaagatcagggtgtcagcaaggccatattcctttgaaacctataggggagaatccttccttgcctcttcctagcttctggttgtcatcatca

SEQ ID NO: 846 - DNA, 201 bp, Homo sapiens
gacaataaatctgctggctccttgatcttggatctcccagcctctagaactgtaagaaatttttgcttgttgattaagttaaagaggttcagaacgtgcarccccgaaacagaccattttgacatactgattattttgaagtaaagaaaaatcagaaccagccaactcagtgaaacgtctttacctccccaattgcctaaa

SEQ ID NO: 847 - DNA, 201 bp, Homo sapiens
gctcccctctccatgtgaccacttacagctactaatagtagatttctcattaggaaacctctgagtatctgatttcaccagttgaattttgctttgcaaasagtcagttgtgttatttaccaaacgtgatcgtgttatttgtgctttttgtaattgtgcaggctattttataacagctaatcaaatgaactaattgaaaca

SEQ ID NO: 848 - DNA, 201 bp, Homo sapiens
ttcaacctctgtcgttgattctggaatgatggtaagtcccaggtccaaaggttgaacagtgacactgggcaatgttgaattctgagctggatcctggcctrgtgttgggactgtcacctcataatgagctggaggttgagctgcaacttccttaggtggctctggaagctgaactgggaccatttgctgccttgaagattc

SEQ ID NO: 849 - DNA, 201 bp, Homo sapiens
ggcttggaagtccccttccacgctttactgtgctcctgagcagccggggggtagcgactcagcactgagggctgctccctagacttcttcccttcgctctkggaggagccgggtacaaaccggtcttcagttttctttgtctcctgagtcccactgtctgtactcacccccatgtgagaagcttttgctgccctcctgttg

SEQ ID NO: 850 - DNA, 201 bp, Homo sapiens
tgtacaaactgggagacacacacacacgaaacaatactacattacccgatacaaattgtcttactttccaacagtgtttaaaactgtatgacgggtatctrtcagagccttctccactttcaacacgccttttgcaaaaaacaatggctttttcatacaagaaaaggtgtcgctgcattggtttgaatctagccaaatcct

SEQ ID NO: 851 - DNA, 201 bp, Homo sapiens; identical to SEQ ID NO: 742

SEQ ID NO: 852 - DNA, 201 bp, Homo sapiens
taatgcagtaatttgtgagttttactacctggaagatcgtgtccatgaggaattgatgagctgtatgaatggtagactctcggcttctttctggtttctcmttttctgtctccttatgggctttgtctgttctggggtcttggtcttcctctgttttaacagtttggatctccacttccatctcatcaaagcctattttca

SEQ ID NO: 853 - DNA, 201 bp, Homo sapiens
aataacccacagttgtacattctttcagagaagggcataaagtaggaaaacagccacttgttgaacaagctgtcttgttctgcatactttcaacattaaarctggatgaaatatgaacataaaattatgaggaatgagaacaaaatggtgttatatattggttttaaaactgaagtggagtaggtgggtttggaaaaaagc

SEQ ID NO: 854 - DNA, 201 bp, Homo sapiens
tttcttacaccctactcagctttatatgttttcacttatcacaacctaaaattacagtacctgactcctctagaattaaagctcaatgagaagaaccaggwtttttgtctgccttactcatagctataaccacagcaccagggcactcaataagtatttgtattaaggaagagaaaaaatacacaaacacacagtaaaaca

SEQ ID NO: 855 - DNA, 201 bp, Homo sapiens
ggacagcaaacagtagagatgtccatgccctgggattaaaattggggcaatgaagtgaacgggtccaaatccctctctcacatccacacactctttccccrgagacacacatggtgagagaaagaatccagagttcactagctgtcatcaattgcatctttaaaaatagtaatagatccagcaatctcacttccaggtatt

SEQ ID NO: 856 - DNA, 201 bp, Homo sapiens
taaattcctctggctaaggagctaggaaattaacttaaatttgaatatttgggggaggtaagagataattttttaaaaggttgaaaaacattgctctagcytaaacatacgatgtctaagaggcactagttattcctagaaaatcttaagtacccaattttgtatggcataccattacaattcaggaagaatgagataaat

SEQ ID NO: 857 - DNA, 201 bp, Homo sapiens
actttgcaaatcctagcttcgggcaaagaagagcaattagtgttgaccactgggtacatggttcaaggagaactgactcatatagtgctgaggtaatatcmaaagactgctttctaactgcaagggaaacactaggtgtgcaatacctcatggtcattatcttaacctagtactcaatcttagcaactaccagtgagccaa

SEQ ID NO: 858 - DNA, 201 bp, Homo sapiens; identical to SEQ ID NO: 840

SEQ ID NO: 859 - DNA, 201 bp, Homo sapiens; identical to SEQ ID NO: 841

SEQ ID NO: 860 - DNA, 201 bp, Homo sapiens
gactccatctcaaaaaaaaaaaaaaaaaaaaattctatcttaaaaaattgtgtacaaatgctcaaaaatggactgtagcgggttctgttcttgtggtcggyggctgtgttgctctctgataaaggtatgtggttgttggctgcaacccctgggctgggatgattcacgttcctggtggaggcaggggagcccagctggagc

SEQ ID NO: 861 - DNA, 201 bp, Homo sapiens
ctatccttgtcctctggactgcctttttcagctaataccagagacttttctacttcaaggacactaaaagaaaaattgaagaacagtgaaaagggcttatrcaatctttctgttttacaatcttcaatgctctttaaaagaaaaaaaaaagttatcttctttctactgaatttttactttagttaatggtttcctatcaca

SEQ ID NO: 862 - DNA, 201 bp, Homo sapiens; identical to SEQ ID NO: 845

SEQ ID NO: 863 - DNA, 201 bp, Homo sapiens
tgttttaaactggttacttatttttaagtcgggggggggacctcttattttataaattatcttcattaaaaataatcaggaatgagaaggttagacctgtyatcacttccaactaaccttgcttgaagtagacccagagaactctattacaggacctctggctcagcatgcagacttacgagtaagtggctccagagtgaa

SEQ ID NO: 864 - DNA, 201 bp, Homo sapiens; identical to SEQ ID NO: 846

SEQ ID NO: 865 - DNA, 201 bp, Homo sapiens
caacgggaaccaacctgacacctcagagaactgaggatataaactacaaacaaccaaacaactaaagagcaagattttcaaaccgtcttctgcagaaaggyaccttgggagccacttaaatgccaagaaggtccataacacctgccttcatggaaaataactttgcttatatctgttacatacactggaaccacatgtaag

SEQ ID NO: 866 - DNA, 201 bp, Homo sapiens
atgatggccagtatagtctcaatctcttgacctcgtgatctgccctcctcggcctcccaaagtgctgggattacaggtgtgaaagaaagcacccggccaayagtttgttttaatgaaacagaatggttcattaaagtattgactaatgtaccaatacttggtacattaaccaatgtaatacagaagtattgtttacaaaag

SEQ ID NO: 867 - DNA, 201 bp, Homo sapiens
aaaaaaaaaaagaaaagaaaagaaagaaagaaatcaggaagaggcaagaaagcattctcccctagagccttcagagggaggagcatggccctgtcgaaacmttgattttacacttccagcctccaggactgtgaaagaataatgtcattgtttaaaaccaccaagtttatggtaatttgttatggcagccctaggatacta

SEQ ID NO: 868 - DNA, 201 bp, Homo sapiens
tggtgcacgtctgtagtcccagttactcgggaggctgaggcaagaggatcacatgagcctaggaggtacaggctgcagcaaactatgagggcaccatggtmctccaggctgggcaacagagtgagaccctgtccccccccaaaaaaagagttaaaattaaataaataaataaaatccaagaccagctacagtgcctataat

SEQ ID NO: 869 - DNA, 201 bp, Homo sapiens
tcttctcgtgtttacatctctgttctagccctgggccctgcaaaccttaggggaggtgtgcccagtacacaaacacacgtgtgtgcacaaagataggtcaytgtcagggcgtggggagatcgcaggacctgcatcagaccagggcttattcagatgctggctctggcaccgcccagctgggtcactgtgggtaagtcacca

SEQ ID NO: 870 - DNA, 201 bp, Homo sapiens
gctggagtcctggagagcagagtccagccagacaaccaggacaggggccggggaggaacccccccaactcctcagggtaaaggcccagctctcagtctgckgaagttccccaatcacaataccatgcccatccttccccccgccgcagcagcacccagaggtgaggctgagatcatcccgtgcccccgctagccccggggc

SEQ ID NO: 871 - DNA, 201 bp, Homo sapiens
tccatccgcagtggggcacccactgaccagtccctcctccccactcaggccatgagcatccgggagcagatcgggcaccctgactacatcctggaggagaygaacaggcgcctggacgaggagtactccaatgtgcgcccccaaccccagccctaaactgccccccacaccgtggacatgggccctgattgcctgggggct

SEQ ID NO: 872 - DNA, 201 bp, Homo sapiens
gcttgcagccccctgcccatcccttcctcctgggggcaccccagcctgttcttggaacattctcctatgtcaccccttgctgcccccgtggggaacactcrctcccgtgcccatgagcggcttcgggagggacttggcaggcggcccagagcctttcctgcaggcagaacaggatggtgggaggaggccggactgaggtcc

SEQ ID NO: 873 - DNA, 201 bp, Homo sapiens
agggaccaggctgtgtcttggaccgggagacaggcttctgggctgtccacaactctctctgtctcccctctccctgctccacgccatggggacgagcagcygccaggatcctccagaacatggacccgaccacggaaccgtgtgacgacttctaccagtttgcatgcggaggctggctgcggcgccacgtgatccctgaga

SEQ ID NO: 874 - DNA, 201 bp, Homo sapiens
tgccagcactgaagccttcactttgccctgtgggtggtcttcacttattcccacagtgactatctccgcgtccccacctttacctaatcttcgactgcaaragccctgcttgtcggggccccaccgtgctgagccgagacacaggacacacacaggccccagggctcccctgcctaccccgcgccccctcccagcccaccc

SEQ ID NO: 875 - DNA, 201 bp, Homo sapiens
ctcctactcaaagtgtggcccacagaccagtggtgtcagccattgcctgggagcctgttagaaattcagaaactcaaggtccaaccaaggccgcaggaccrgtgttggtatttcagcaagacccccaggtgattcatctgcacattcatgttagggaagcactggtttaaaacagtgttgaccaaatttgcttgataattg

SEQ ID NO: 876 - DNA, 201 bp, Homo sapiens
tgactcccagcatggaggaggggacccagggactccagcccatgaccctgactccacctggcactgggcacttccctcccacggcctgtgacatggggacracaacactgcccaatacagcagcgaagcccagatcccagcctgggagactctccagacggccagcatcctccaccggggggtgtgctacccccgccatgg

SEQ ID NO: 877 - DNA, 201 bp, Homo sapiens
ctccacctggcactgggcacttccctcccacggcctgtgacatggggacgacaacactgcccaatacagcagcgaagcccagatcccagcctgggagactmtccagacggccagcatcctccaccggggggtgtgctacccccgccatggccatgctgacctccgcccctcggtggggactgccctgcctgggacaggggc

SEQ ID NO: 878 - DNA, 201 bp, Homo sapiens
ttccttcctcttattctgggaagccccatacgcatatattagatcttttaactaatgcgtcttgttgagtcggagtcacataagtctcctgttctctgttrtgcttttctttcccacgggtatttcagtggctgtttgcaccgtttctgttgccctgtctctgtctcccctccatggtccacctgccacggggtccagtct

SEQ ID NO: 879 - DNA, 201 bp, Homo sapiens
ctaccaaatggccaccttcttgctgtgtcctcatgtggtggaaagagacagtgagctctgtcatttcttccccctcttatgagggcaccagacttaccagrttatgccccccaccagccctgcccattgagctgattttaaacctcctcacaggccctatccccaaatagtcacattaggggttagggcttcaaaccacaa

SEQ ID NO: 880 - DNA, 201 bp, Homo sapiens
ctcgcactcaccacctcctttccgttgctggcctgggggattcctttgctctgaagctcagccttgcccttcagcactttacctcggtgtatgcagcatgyggcactttctccctgtttccaccgggcggggggctccttgagggctgggccctgtcaggctcacatctgaactgcagcatctggcctggctcacagtcat

SEQ ID NO: 881 - DNA, 201 bp, Homo sapiens
aggctgaggataggtgggtctgctcaccccgtaagcccagggccccacgccaggcctgggaaggctgacgtgggggcccgtgggatgatcgggtggccccvccaggcgctgtttggcacaatggtggaggaggtgcgctggcgtgaatgtgtgggctacgtcaacagcaacatggagaacgccgtgggctccctctacgtc

SEQ ID NO: 882 - DNA, 201 bp, Homo sapiens
gccatgggggggtaggtcagagacatctgtgagtcaagcgtcaggggggcactgagtctaggagctttggggaggaagaaagggctgcctccctttcctaragggcaggaagtcctgcagcccagaaggtgtggcaggacgctgggcagagtgctccctgggctttgcctgagtctggggcccagagtctcgtgctcctgt

SEQ ID NO: 883 - DNA, 201 bp, Homo sapiens
aaaaccgcagagtatgatgtggcggggaggcagggagggacgaggacagggagcactgctccggggaggcgacatttgagaccttaaaggcctgaagaggyggcggggtgatttcccgggagcagaaacagccagtgccagtgcagaggccagaggcaggagcaggcaggggccggacccgtggtcagcagcggacaggaa

SEQ ID NO: 884 - DNA, 201 bp, Homo sapiens
aaaaagaaaactctgctagaaatttgatagggatcactttgaatctctctatcaatttggggagactttgcaatgctgagtcttccaatccatgaacatgrtatatgcttccatttatgcttcaatttttcttaataacttttaaagctttcagtgtcaagttcttatacatattttattagataaattacaggtgtttgg

SEQ ID NO: 885 - DNA, 201 bp, Homo sapiens
catctgcacattcatgttagggaagcactggtttaaaacagtgttgaccaaatttgcttgataattggaatcacctggggaaattgttacaaatccagacrttgggccctccctcagtttgcctgggctacagtcacaaaatgctcaggtggcttaaaaacagaaacatattttctcctcctagttctggaggctgtgaag

SEQ ID NO: 886 - DNA, 201 bp, Homo sapiens
ttactttttgacatttcaacatgctccaagctcatctcgtatgtttcctaccccagttgtataatcaaccatttttctaaggagccctggcttcttttatyggataatggtatcaaaaaccaacagcttctaggataatgtggtgtctgaaaaacaaacagaaaccaagagctgggtcctattctttgcttattgctactc

SEQ ID NO: 887 - DNA, 201 bp, Homo sapiens
taaatgagtctgagctgttattttctctcaatatcttgaagatttagctctcatgccttctgactccccttgctgctgttcagacgtggcttcagagaaamgtacagtcagcctaactgccgctcctctgttgggtgaacaatcttttctccttgagctatgttctctttgtcttgggtattctgaattgttatcatgagt

SEQ ID NO: 888 - DNA, 201 bp, Homo sapiens
tgcctccttccctggagaagagaccctgacttctccctggagggaggccggtccctgacgtggcctctagattgctgagtggcctctgactctaagaacakgcgacaactcgggtcccactgtgctgtctctgggccttttctgagtgatgttgtcatgcccatgcctgtgtgtgcctgtggcaggcaagtgggtaggagt

SEQ ID NO: 889 - DNA, 201 bp, Homo sapiens
gaggtctgcaccacccctggctgcgtgatagcaggtaagccccgcccccttgccgtccacagcctgcccaagggctgggggctcccggctgacactgacgyaggccccgcccaaggcccagggaagcaactccaagacacggcgggcggtggagccgggtgggccggactcggactcgctgtggagcgggcggagctggtg

SEQ ID NO: 890 - DNA, 201 bp, Homo sapiens
tgtctcccctccatggtccacctgccacggggtccagtctgccatcacccgtctcatgacactgacctgcagccctgggatgtccatttggttctctcgtwtaggttccaatcagctgtggaattctccatccagagatcccgttagacggcatttcctgtttttagtaacacatgaatgagttattttaaaatacctgtc

SEQ ID NO: 891 - DNA, 201 bp, Homo sapiens
gtgctccaagcacgtgaattcctttaataggaactgaaacatggataatctgccccccacaccacacacacacatccacatacatccacatgcacacacamgcacatatgacacacatacagcacacacataacatgtatacacacataacacatatacacacatacacatacacacatacacatacacacatatacacat

SEQ ID NO: 892 - DNA, 201 bp, Homo sapiens
cccggggacgatggggcaagtgatgcccatgtcggtgcatgccttcacaaagcggaagaatgtgtcagcctcaaagaaaagctgcgtgatgatgaaatcgrctcccgcagacaccttctccttcaagtgcttcaggtcagcctcaaagctccctgcttcggggtggcctttggggtaacctgccaatagggatgacagtca

SEQ ID NO: 893 - DNA, 201 bp, Homo sapiens
tgtttttcctcctcttcaggagacccacatagagattttccaaaccccacaaggacatccaggttctccacggacttatcggtgtcggcagccaatgacaygtctgaaggacttttctcatcactgctctctatgtgcagctcatcaaacgtttcattgtcatcagtgtctgaaagctggaggttgagagccatgcggcca

SEQ ID NO: 894 - DNA, 201 bp, Homo sapiens; identical to SEQ ID NO: 833

SEQ ID NO: 895 - DNA, 201 bp, Homo sapiens
gggacggccacacctgggacattggggacgtacagaagctgctttccggagtagaaagactcaggaaccccgacctgatccaagcaggctactactccttyggcctcgctaacgagaagagagccaaggagttggaggccacttttggctgccggatgtcaccggacatcaaacaggaattgctgcgatgcgacataagtt

SEQ ID NO: 896 - DNA, 201 bp, Homo sapiens
cttttggctgccggatgtcaccggacatcaaacaggaattgctgcgatgcgacataagttgtaagggtggacattcaacggtgacagacctgcaggagctsctcggctgtctgtacgagtctcaggaggaggagctggtgaaggaggtgatggctcagttcaaagaaatatccctgcacttaaatgcagtagacgttgtgc

SEQ ID NO: 897 - DNA, 201 bp, Homo sapiens
tgcctccttaacagactttcaggtacttgggaatttgaaacaaatctccttgatgcacaaagtaaccttttcttcccccattgtaccccaggttgaaaatmgatgactttaatgatgaactcaataagctgctggaagaaatagaagaaaaaaacccacaactgattattgatactgagaaacatcatccctgggcagaaa

SEQ ID NO: 898 - DNA, 201 bp, Homo sapiens
aaaatcgatgactttaatgatgaactcaataagctgctggaagaaatagaagaaaaaaacccacaactgattattgatactgagaaacatcatccctgggmagaaaggccttcttctcatgacttcatgatctgaatccccccgagtcattcattctccatgaagtcatcgattttccaggtgttggtgaactgcctgtga

SEQ ID NO: 899 - DNA, 201 bp, Homo sapiens
ccgacaatgagcttctggatgagggtgctaagttgctgtacacaactttgagacaccccaagtgctttctgcagaggttgtcgtaagtctctcctctcttmcagagcagctgtgctttcgatctggggccacagacgagcaatggtcatgcctgacttggctgtatggaacctctcgctgatgtgaacacctgttcccatg

SEQ ID NO: 900 - DNA, 201 bp, Homo sapiens
tctcaggaaaaaataaaaaagaggtaggaattagatatcgtgccagaaaatgctggctctatcagcaggtgagtggtctcaacttggctatcttacaaatmccttgtgagttagctacaatcagatgcacttgaacctggaatcctatctgggaggcaatcttaaaagaatttgactcgggatgggcaaggtggctcatgc

SEQ ID NO: 901 - DNA, 201 bp, Homo sapiens; identical to SEQ ID NO: 348

SEQ ID NO: 902 - DNA, 201 bp, Homo sapiens; identical to SEQ ID NO: 660

SEQ ID NO: 903 - DNA, 201 bp, Homo sapiens
tctttacaaacacttagatgtcctaggaattcttgtcatgttcctgatttccatttttattttgtactatgaactcatttggaaacttctctttgggactygttgagattgaaattgttttcctctagaggatttatttttgcttttgccaggaacctgaggacagaactaactgggaccaccataagcttggggtctact

SEQ ID NO: 904 - DNA, 201 bp, Homo sapiens; identical to SEQ ID NO: 666

SEQ ID NO: 905 - DNA, 201 bp, Homo sapiens; identical to SEQ ID NO: 670

SEQ ID NO: 906 - DNA, 201 bp, Homo sapiens
attgcaggcctgttgttaagaatttcaaaggagacttttctttttgctctacccagagccaaggctgagaaggcctgggatagacctgtctccctccatgrtttctactgaggatgtcacccttaggggatcttgagtttatagtctatgatctggttaggctccaggctttgtctcctattctaccattaaaatccaggc

SEQ ID NO: 907 - DNA, 201 bp, Homo sapiens; identical to SEQ ID NO: 349

SEQ ID NO: 908 - DNA, 201 bp, Homo sapiens
cttataaaaataaaataaatacataaaatgtgactagcaattttaagacacttaaatatttgaattaatttattgaatacctgctctgggaattagtgttrtgtttccatttacagagacaaaacaggtctaattgattgactaaacaatagatgtaaatgtggtcagtgtttggatgtctattcatagaataggaacaat

SEQ ID NO: 909 - DNA, 201 bp, Homo sapiens
aagatgtgtgtgaacacaaatataccttctgtttgaggtcagcatcatagtgggtcgtgaatcatgttggccttgctgctgtctcctcatttctagggtgraaaaaaaaaagcatgaaaacaatcacttaatgttgagccccattactgatgctctctggtcctgcactagcctcctagaaaaatcaccacaggagaagcc

SEQ ID NO: 910 - DNA, 201 bp, Homo sapiens; identical to SEQ ID NO: 350

SEQ ID NO: 911 - DNA, 201 bp, Homo sapiens
aaaggatgctaagggaggcctcagaggcttatttaatcagttggttaatgggaaaaagtattttgtggtacacaaatacgctttaaaaatattttagttaygtcataaaagtctaaacctggggttgacaaactatggctcacaggctaactctggcccaccagctgtttttataaatgaagctttattggaacacagcca

SEQ ID NO: 912 - DNA, 201 bp, Homo sapiens
ggagtctgattgagaagcgacagccagtgagggtgaagacgcagaaaccttcacagtagctcctcctcttagggttttatagaagtccatcacatctcccytctcctgagcaagcacactgctggggttttcttctctaccaggagttaatgattctttggagtccatcagtgaatatcaactacaaaacaaaaaacaaaa

SEQ ID NO: 913 - DNA, 201 bp, Homo sapiens
gtgaggaaggttaacgttgcccccagcatccccagtccagcaaagaggcaggacgagtcccacacgcaacatggtgtgcagtatggacaccacccagctcraggctagtaagcaggcacaccgttggtgattcattaccaaagcatagtgcagggggtcacagatggccacatagcgatccagagccatgacagcaatgac

SEQ ID NO: 914 - DNA, 201 bp, Homo sapiens
atattccccaccacagttcccatatagaaaattaagaagattacaaacactattttctgcctcaagggatcctgtgttaatcctaacagtatgaattcagkcacactgttattttgctgcattgtttcagttgatgtgaagaaaccacagattagaactagttaatctgcaaaagaaaaaaagaaatagattctaaattta

SEQ ID NO: 915 - DNA, 201 bp, Homo sapiens
ggatttcaacgtttttgcagaaggacagctgcaataccatcagactctgaaccagggcatccatagtgctcatgaacatggagagaagaatcagcaagccscagaaatggacattcatgaggactgtgtacctcagtgggtggcaaatggccacatagcggtcgtaggccatgactgcaagaaagcaactttccaagccag

SEQ ID NO: 916 - DNA, 201 bp, Homo sapiens
agcaggccaggtcttcgtgaactgcagcgacctgcacacggacctggagctgagcagggagaggacgtgtgagcagcaactgctgaacctgagcgtgtcarcccgtggcccctgcctctcgggctgcgcctgtccccaggggtaagtacccatggtgtcgtgggcccgtgatcctgaaggctggcagaaccaagggccaca

SEQ ID NO: 917 - DNA, 201 bp, Homo sapiens
tcttcactcaggcctggcatctggcactctccacaggtgaagcagcgggagaatggcgtggcgctgaggtgcttccccggggtcgtgcgctccctggacgygctgggctgggaggaacggcagctggcgctggtgaaaggcctcctggcggggaatgtcttcgactggggggccaaagccgtgtctgcgtaggtgtctgcg

SEQ ID NO: 918 - DNA, 201 bp, Homo sapiens
ggccggtgactgggtgaaggcgccgcgcagctttcccgacgccggctgtacccggacctcctggtcgagcctggcgcgccgcagccatggccatcgctcamctggccacggagtacgtgttctcggatttcttgctgaaggagcccacggagcccaagttcaaggggctgcgactggagctggctgtggacaagatggtca

SEQ ID NO: 919 - DNA, 201 bp, Homo sapiens
ctgcttccctctctggtgcttggaatactcttttgttgaacttaacacagagctttataacctgtctatgcatgttttgcatggagattgaaactactctrtaaacatttgttgtgaattaaaggtgatagcttttggcatcatcagaccttgctaattgattgttatgtgcatgatgctgtaccttggcaatggggtgtc

SEQ ID NO: 920 - DNA, 201 bp, Homo sapiens
cttgtcaaacccctaactgaggcagcgagagcttggtccaaagtggagaaagggaggcaatttgggggcatttgccctggctaagctaggaactctgggcsaggcaggccccgctgcatgctgtggggtttctgggggcagcagggagacattagttacttggggagaagggggcctaaagagaatctaccatctgcttgg

SEQ ID NO: 921 - DNA, 201 bp, Homo sapiens
tggagataatctctccctttggtcaattcctccttcagtactggctgtgtgctgaactcggtgctgacctccaaggacccgggagtaaaagaggcatgatycctgtcttggaggtgcaagtcttgggtacctggttgggacagaaaggcaggaggaaggagttagtcaccctctgtgaccaatctccacctctagcacatg

SEQ ID NO: 922 - DNA, 201 bp, Homo sapiens; identical to SEQ ID NO: 367

SEQ ID NO: 923 - DNA, 201 bp, Homo sapiens; identical to SEQ ID NO: 370

SEQ ID NO: 924 - DNA, 201 bp, Homo sapiens
cagccttagggagctggcccctttgcactggggctgagccacatgtccttgtagagggtgcagtttgggatgtacgcgctctacagcaagaataagcctcrctccgatgccctgatgtcaagctatgggcacaccttcttcaaggtaagtgaacctgagattaggaggagtaggggatgcggggagtgcccccaaaccact

SEQ ID NO: 925 - DNA, 201 bp, Homo sapiens
cgcacgtggaacatcaggttcatgtttccaagcaagaatcatgggttggggaaggcaagtgtttactgtggtccagctgaggactgtggtgtctgaaactytgtcacatgggaggctacaggcccggggctggcttggctcccgtgaaaacactgcagcgggcagccagtccggaaggcagcatctggcagggcctccagg

SEQ ID NO: 926 - DNA, 201 bp, Homo sapiens
tgtcattccttcctgacttcaccctctctctaggactgaaggactcctaaagctagatctccagcccagacctttaccccaaactccagacttctataccyaacttaaaactcgacctttctacttggatgtctaatgggcaattcaaactttcgttgttttttttttaagacaaggtcttgctctaatgcccaggctgga

SEQ ID NO: 927 - DNA, 201 bp, Homo sapiens
tttaaaaactcaagtcaaatcattctactcctctattcaaaaccctcctgtggcttttcatctcatgcaaagtaaaaccccaaatccttagcgatggccaygacgcgtgacgttgtctggtccccagcacccctctgaccgggtccgctctttccccacgctcactccacttgagctctgctggtcccggctcttccttgg

SEQ ID NO: 928 - DNA, 201 bp, Homo sapiens
acgcgtgacgttgtctggtccccagcacccctctgaccgggtccgctctttccccacgctcactccacttgagctctgctggtcccggctcttccttggaygcactgagcatattcattcctgctttggggtccatgcactttgctgctcccttttcctaggagagttgtgcccacatagtcacagggcttgtgtcctcac

SEQ ID NO: 929 - DNA, 201 bp, Homo sapiens
tggctctacccaaaccaaagcttgggggtgtcgcaccttgggtgggactggctccacagtgtaccagctgtgtgaccccggctgagtctccctgacctccrgttgtttctctgcagaatgagtgggcacaaggaggatgaagagggctcggggcaccgcctggcatggatgatgccatctgtcaaggagagtcactggtag

SEQ ID NO: 930 - DNA, 201 bp, Homo sapiens
ttcctaatagctagttccaatgatgttaattacccgccctgagctgaaataacagtagacaaagatagaagctagcctctggttttacaaagcctttgtayaagtcctctctgtcttttctgtccatgccagggaaatgtattgctggtgctagagggagaggaaacgtggacggccaagaacagggcggcacagtcctct

SEQ ID NO: 931 - DNA, 201 bp, Homo sapiens
tctcatctcgatccttgaggactttgagttcattctcagtctctccagcactgtatttatctcacactgatttcaatatccacacagaagatccttgtgtrcctctcagttctgtgtcctactgtccacctggtcacctccaccctaacctctcactcccacggtcgcaccctagaactgtcattttctctggctgcagtt

SEQ ID NO: 932 - DNA, 201 bp, Homo sapiens
agaagctgccccagggccgcaatcctcagccccagcccagaggccccagctcaagtcctggtggtgccaacccagtgatgaagaggagggtgaggtcaagsctttgggggcagctgagaaggatggagaagctgagtgtcctccctgcatccccccaccaagtgccttcctgaaggcctgggtgtattggccaggagagga

SEQ ID NO: 933 - DNA, 201 bp, Homo sapiens
actcccctctcctcacagcactgactcttgccttctcatgttcttttccccttggtgggcctcgccccacacctggcaccctctctgcacagtcccctgaycctgactgtctatccacagttcctctgaccatccgctgcttcctgggctgtgagctgcctcccgagggctctagagcccatgtcttcttcgaagtggctg

SEQ ID NO: 934 - DNA, 201 bp, Homo sapiens
ctccttgggggcctattcttcgggctaactctttgcatgttctgcagggagccaaacaagccgctcctacacttcgctggtcctgggcgtcctggtgggcrgtttcatcattgctggtgtggctgtaggcatcttcctgtgcacaggtggacggcgatgttaattactctccagccccctcagaaggggctggattgatgg

SEQ ID NO: 935 - DNA, 201 bp, Homo sapiens
gctgtcactccaaaccttctggtgtttcagttggggagtctggcttcacagtgagctgaaactttcccttgccagcctccatcaatccagccccttctgasggggctggagagtaattaacatcgccgtccacctgtgcacaggaagatgcctacagccacaccagcaatgatgaaactgcccaccaggacgcccaggacc

SEQ ID NO: 936 - DNA, 201 bp, Homo sapiens
atttttctcagcaaaacaaaagccctgtagtttttcttatttccttaaacatggtgttttatttcatccaaatgcaagtgaagaggagattagatttggtytgtggaattccagggaacagattaatgaatgagaggaagtcagagagaaataaatgttagtttaatgtaactttctgacccagcaattcaataatggaac

SEQ ID NO: 937 - DNA, 201 bp, Homo sapiens
gttattagacataatgttattgcacatttattagactataatatagtataaacataacttttatttattattgtttttctttttagacgaactcttgggcrtgatagtgcgcgcctgtaatctcagctattcaggaggctgaggcaggagaattgcttgaatccaggaggtggaggttgcagtgagctgagatcgcaccac

SEQ ID NO: 938 - DNA, 201 bp, Homo sapiens
accccaaaaggataaaagcaatgaaaaccccacccaccctaatcaaacttctgaaaaccaaatattaggaaaaaaattttaagagtagccaccaaaaaatsacatgttacatatgggggaacaataattcttatgactgtagatttttcatcagagaccatggaagccagaagacaatggaataacacctttaaagtgctg

SEQ ID NO: 939 - DNA, 201 bp, Homo sapiens
ctgttttaggacgtgggaatagagcaatatagcagagaacaaaaacaaagtctgtcttagaagctacagtttactgggagggacagaccctaaacaaatawtttttttttaatgtcagagataattagtaggaaataggtagaaaaataaggaaggtcgaagggagaataactgagttgctgttttagacagcataatcag

SEQ ID NO: 940 - DNA, 201 bp, Homo sapiens
gatgttattattctcatttcctggcaacgttattattctcacacccagtaaaaagaaaccaaaactctatttcttctaatatctcttggtatatccgatgrtctgttgtatgtgtactggcatataacagggttctcatgggtagccttaatcttgcatcacactcactataatcaggatttctacatatcccaaaaaata

SEQ ID NO: 941 - DNA, 201 bp, Homo sapiens
aaggagcccagtcttttcttgggaagataaaacatacaaaagagaacaacacaaggcaagatgcattgtataactagaagaaacacacaaataaaaatgtkatgttatgtggccgggcatggtggctcacgcctgtaatcccagcactttgggaggctgaggtgggcagttcacctgaggtcaggtgttcgagaccagcct

SEQ ID NO: 942 - DNA, 201 bp, Homo sapiens
agccactgcgcctggtcttctcactcattcttagacccagtgcaatctgacttctctataaactactctgagatcaccagtaacctctaattgtcaaaccrtcaccctacatggtatctgcaaatttgcggactagaactctctttttgccttaacttctgagataccatacttcaatttttaaaactgttctgtctactt

SEQ ID NO: 943 - DNA, 201 bp, Homo sapiens
ttaacctttatttactccctcttatttatccccatctaccaactacagtatctataaaacacattcactcctttctaccccattgcttttgttcaagataycataattcctctctttctttgtggtaaacatgaaggtgtaccatccagttctacctccaaagaaagacttcctgttggccgggcatgatggttcacgctt

SEQ ID NO: 944 - DNA, 201 bp, Homo sapiens
tagtttatgaagggtcgagaaggcgggcggccagcctcgaggtagggggttattatcttccgctgcccgccgccccctcccacgccggcccaggctgaagytgactctgcccgcaggcctccaaagacttcatatgctccagatctcctacttccgcgacccctatcacgtgtggtaccagggcaacgcgtcgctgggggg

SEQ ID NO: 945 - DNA, 201 bp, Homo sapiens
agagtggcatggggtagattcaaacagcctagcaaagactctgaaaatgaactgacactgcaaccacccacagcaggtgagacaaagcttgtagtctgaamctaattgagttatttgcctgctaaaataaactagtcaccatccagataatttaaacaggactcagagtcccacaatctaacactcaagatgggcaagata

SEQ ID NO: 946 - DNA, 201 bp, Homo sapiens
cacctcagccacccaggccagatgcagtgtaggccatggctccaacagcagcatttctcttttcttccccacccccatccctgggtttagaatgagaaaakgctcaagttgcccccctcccaacttccctacccgcaacactctttttattttctctgttcccagctccatacttccatgctttttttttttttttttttt

SEQ ID NO: 947 - DNA, 201 bp, Homo sapiens
tgtgtattattatccctagatcaacagctaaaaaaaaaaaaccacaaaagatatagacaaccaatatattaaattggaatataaaacatattcaaataatycaaaatataacaggaaaggggacattgagaggcaaaaaaatggaggagacaagcagaaaaataacaaattgtagaccaaaatccactcttatcaataact

SEQ ID NO: 948 - DNA, 201 bp, Homo sapiens
tccaaaatataacaggaaaggggacattgagaggcaaaaaaatggaggagacaagcagaaaaataacaaattgtagaccaaaatccactcttatcaataamtacattaaatgtaaatggtctttaaaaatgtaaatggtctaaacacaccaattaaaagacaaagatggctgggtgcggtggctcacgcctgcaatcccag

SEQ ID NO: 949 - DNA, 201 bp, Homo sapiens
tgccttcacctatggcccttccccagcaacggatggcacctggaccaacttggcccatctctccctgccttctgaggagctggcatcctgggagcctttgrtctgccacactgggcctggggctgagggtcacagcaggagtacacagcccatgcatctgtcaggtggggatggagcctgggcccttgcggatgctccctg

SEQ ID NO: 950 - DNA, 201 bp, Homo sapiens
tgagttgggttttctatttgcaatagcaaaagtcctgactggcaaggtttaaaagtttgaagactctcacaggtaagtgcagctcaggatcctgtgagtgsagcagaaagtcttaagaaatggcaggggctggttgaacccagattttccattggctgagcagatatccccagaggcgtagaaaattaaatttgttttatg

SEQ ID NO: 951 - DNA, 201 bp, Homo sapiens; identical to SEQ ID NO: 897

SEQ ID NO: 952 - DNA, 201 bp, Homo sapiens; identical to SEQ ID NO: 790

SEQ ID NO: 953 - DNA, 201 bp, Homo sapiens
ctcccatcagcctaggatcatggaaaggccgctctaggctcagagtaaagcaagagggaggccgagcctagcgcccccgtaccttgcagccgccggctcarctccttggtgaagaggacgatggcgagcttgctctggcagtaggcggctttggtgttatacttcctcgtctgccagttcaagtcgtcaaagtctatgtgc

SEQ ID NO: 954 - DNA, 201 bp, Homo sapiens; identical to SEQ ID NO: 791

SEQ ID NO: 955 - DNA, 201 bp, Homo sapiens; identical to SEQ ID NO: 792

SEQ ID NO: 956 - DNA, 201 bp, Homo sapiens
gtgtattcttgagtctatttaaagatgaacaagaatagaaaagctagaggatggtcccagttttacataaaaatatataaatacacacacaaacctattakaaacaagactagaaagatccataaaagtgattctcctggggctggtgcagatcaaagttgtttagttctgtcttcttttttattgagacagagtctcact

SEQ ID NO: 957 - DNA, 201 bp, Homo sapiens; identical to SEQ ID NO: 793

SEQ ID NO: 958 - DNA, 201 bp, Homo sapiens; identical to SEQ ID NO: 794

SEQ ID NO: 959 - DNA, 201 bp, Homo sapiens; identical to SEQ ID NO: 795

SEQ ID NO: 960 - DNA, 201 bp, Homo sapiens; identical to SEQ ID NO: 796

SEQ ID NO: 961 - DNA, 201 bp, Homo sapiens
tggaccagaggcaaatcatgaacagaacgggagtcaagagaaggggtttctaagatggagaagtgggggcgggtgtggatccagtgggatgtggcttcccsaggttgcaaccccaaggaagtctctggaagcagcaccagtcctgatgggggagcagaagagctgccatcctcagtcagggtccgagtcagggtccgagga

SEQ ID NO: 962 - DNA, 201 bp, Homo sapiens
ctcctcgagcggttgtttctctcgttgctcctgggcactggcctcagatggtgccttgcggggctgcttcccaggagcgcgcttctgttccaccacctctycggaaggaaacaccactttcactgggctccgccgcagcgcccggacccagcgcctcgcgtcaaggtcccaagcctggaccacctgcagcaacggtcgcac

SEQ ID NO: 963 - DNA, 201 bp, Homo sapiens
atcttcactttcagggtgttcacaatccccttgtggccagaccatggtcccaagattaagacctcttggcccacatgaccccttgtttgcctctcgacagkagaatctgctgcctgtgaccatctctggcacagcattagcctccaatcgcccctctcccggacactgagtccacatcagcactatggataaatctgcctc

SEQ ID NO: 964 - DNA, 201 bp, Homo sapiens
acttgaaaggcatcaaaacaggccgctgacaatcacagtgttcctcctgtcagctttcctggtttcctgtatttcaaagatcacagatgatcagcaccctsttctcataaatgtcctgtgatgacagtcctgtgctgttggaagctcttcctggtatgtggccacgtggtcagccactcagtcaacatgcgctcccacgca

SEQ ID NO: 965 - DNA, 201 bp, Homo sapiens
tcgttttcagtccattcaaaatactttctcatttccctttgatttcttctttgatccatggattaatatttagtttccaagaacttggggattttccatasatctgtgtttttttaatttcatttccttcaaagagaaaatgttttacagtacttaaatcctttaaaattcatggagttgttttgctcaacatatggtaca

SEQ ID NO: 966 - DNA, 201 bp, Homo sapiens
gagacctccttcatccctggcttcacagtacatccatcctaaatccagtgctgagaggtcagcgtttcccctcagaagcagccgttcatcaaagtttgcayaaccgcactactgccatttcactgaagtaaaaatgatcccctatgtgtgtgtgtgtgagctacaaggaattatttctatattttcctgtcacattttata

SEQ ID NO: 967 - DNA, 201 bp, Homo sapiens
tatctgtacacagataattatttgtctaaaatagtatttctactatacacaattaagccctcaaatgctttaaagtaataaaaacggacactggacatacygtgttgtatctgagaatgacaaacactaaaggcaaggctgcagttagttaggacaggtccctgaccttcggctgccctgcctggccagcgagccatcatc

SEQ ID NO: 968 - DNA, 201 bp, Homo sapiens
ggattttactgaagatattgtaagatggaaaacattcatgccatacctcccttagaaacaacataacaatctccattaatacttagttctcccctccatartcctttcctgggtgcattcccaacttggaacttttttttgtcctatctcccgctttccttaaccctataactttctaattctttgccttctcatatttct

SEQ ID NO: 969 - DNA, 201 bp, Homo sapiens
actttttctcatttttcataaaaggcaacaggctgatgttcatatatttctcttgaatgcggattcagtttcactcattgccctgtcttggaaatccccaygttaatgatggcttaaattaggttgatagagtcctcccttggagtccagcttggaaaatcctcactggagaggggcaggcccacttctctttttggaaga

SEQ ID NO: 970 - DNA, 201 bp, Homo sapiens
acataaaagtgctcagcatacgacgatcatgagccatgtctaagcaggcgcaagccctcccaggcttctcatctgcaatattggccatttctcttcatgcytcagtgtcctgtttgagttgagcatgttttttttacaagtgagtctctcctccattggccgggaaccgcccgagagccgggagcatttgtcattcttgat

SEQ ID NO: 971 - DNA, 201 bp, Homo sapiens
aagatagcattcagcagagctttagcaaggaagcaaaggcccaagcccttcaggcccagcaaagagagcaggagctgacacagaagatacagcaaatggargcccagcatgacaaaactggtaggtggtagggaaagattagagcctgggcactagctcacaagtcaggcccacgccttactgtgaaatgacatcaggaac

SEQ ID NO: 972 - DNA, 201 bp, Homo sapiens
ggtgtgccttcttccactgcactttctggccatttctaagttttctgcactaagcatgtgttagttgtgtaaaaggaaatgcaaacagtaacaggctcagytggggtttttcgtcttcccctttttgttacctcccctagtaacccttgcaaacagagttagactcctctatctctttctctgtcatacctttttgacttc

SEQ ID NO: 973 - DNA, 201 bp, Homo sapiens
aaagaattaaaatcaagtctggttctcctcactgagctcattggggaatccctggcctagggatttccctcttctcccgcccccaggcctcggaaaatgarctggtgtcagctgctgcccagaaggttacccagcgtgttctctctctcagggtccttcccttaaattctcaagtttgacatggaatagaagaatgtcggg

SEQ ID NO: 974 - DNA, 201 bp, Homo sapiens
gtggtaccccctccccactgcacgatcctcaggaagaattcctttattgaaaccattattgaatagggtagatttaggcacgggaaatgtaaacagcaaaycagccactaaaagtgcgttaatgtcacgcctgtaatcccagcactttgggaagctgaggtgggcggatcatgagatcaagagatcgagaccatcctggcc

SEQ ID NO: 975 - DNA, 201 bp, Homo sapiens
atacagtaacactatggactagccaatctggtgcttgagcagaattgaaaatagggtgattcaaattggcagaactctcggtgcctctcctaaagagacgrcttctcaggcacacgggaggacaaaaacgccactgagagactatcagccctgctccctgcttttccaggggacaaagtgaccggccatcgcccagaactg

SEQ ID NO: 976 - DNA, 201 bp, Homo sapiens
gatttctactcagcgctgagctacttgcccatgactccacaggctttccaacattgtctgtgactcttagtgattctaaaattctagcaatggcacaagaytgagtggaaactctgcctcaccacaggactgaccatgagtagctcacttcaatggattggtatttcacaacttagcctggacatcggtcaagttggtaag

SEQ ID NO: 977 - DNA, 201 bp, Homo sapiens
tagcattattactttgatattcatccatgtcaccacatgtatcaatagtttactcactttgctgggtaatatttcagtacatagatgtatcacaatggacmcactcatctgtcaatgaacacagggcctgctcccagtttggggcaattacaaacaaaattgctattaacttttatgtccacgtctttgtgtagacatatg

SEQ ID NO: 978 - DNA, 201 bp, Homo sapiens
tagttggtatgcatgtcaaaatatttttctaaattataaaatgaaatcacattacacatgctgacttttaatgttttctctttgttactaatatgtcacasttttagatcaataaatatcacttataaatagccacattatcagaataataagtaacataaccaagctcctgttgatagatttcttggttaagtttccaga

SEQ ID NO: 979 - DNA, 201 bp, Homo sapiens
gctttgagggtagctcccaggaaaggctgcctcagccccagcgtgatggggacgggtaggggccgatgaggcttcccagagcagcgatggccttaggtatygccagaaggaaacctacttttcctccaagatcagagggaaggatgaggtggggtgttggagcatcaccatatatatacatcacacacacagggaaacact

SEQ ID NO: 980 - DNA, 201 bp, Homo sapiens
gctctgtgagtgccctggggacttcaggcagtaagtgcttggaatgattaatatgaaaaatgcatctggaaatgaaaacgaagaggagtctcattctcctyacaaaatgaccctgtgctcaaggaacctgtaagtactgacttttcccactcggtccaaaatccctctgccaaacatgtgttcacagacagtaaatgagca

SEQ ID NO: 981 - DNA, 201 bp, Homo sapiens
cagggagggccccagcagcacctgctttaggcctggccagccaaagatcaggaccactggagccactaggtctcctggcaggtgactaggctcttgtcacrtaggagggagggaccgtgactcctggcatgagtgaatcttcagcctctaaagccaagaactctgtcagacctcaggttgtggggagtcttccgtggaagc

SEQ ID NO: 982 - DNA, 201 bp, Homo sapiens
gccttcttacattaaacagctatcctccccctcactttctatcttcacattgctttttcttcaagactttgcgacatctgatacacaggcacgtatacatrcacacatatgatatacatgtatttgttactgtcaatgttcatcaccaataaaatataagttccacgagggcaaggactttaaaaaaaagtttattgatgc

SEQ ID NO: 983 - DNA, 201 bp, Homo sapiens
ctctcgacagtagaatctgctgcctgtgaccatctctggcacagcattagcctccaatcgcccctctcccggacactgagtccacatcagcactatggatraatctgcctccaaaaaaggaatgagaggagaagacatatagggaaggaatcaaaaagaaaaggaaagaaaaactatgatgtgaacccaaagatgtgtaac

SEQ ID NO: 984 - DNA, 201 bp, Homo sapiens
tgtggcgcagtgagcccaggggctcaaggtgttagcagtcatcaacagtgctatttgaaactgtgggtggatgaagaggtgaactcaacaccacaaatatsacagagcagtaaccaccatggaaaagaaaagagagcttatgtgtctaggacaccccaagaaatctcttctgaatgaatgatggcaatgaaatagccatta

SEQ ID NO: 985 - DNA, 201 bp, Homo sapiens
gatgaggtggggtgttggagcatcaccatatatatacatcacacacacagggaaacactcctacttggatggaggatctttgctgttctgttgaggccagyctgatcctggaggcagggcagggcctggctgttgcccaggctccaaagaggcgccagggcgtcccttagtccttacactttctccagaacctgcgggcag

SEQ ID NO: 986 - DNA, 201 bp, Homo sapiens
ccccgtgtgcttctgtttctgagcaatcacaggctccttccccgaagacaggatgtgggtcacattgtatagaataagcatgccattgtccccgccgccarcaataaccccggagctttccagaagcccactgccaaagctcccccagaccagcttgtgaaacctataaagaggaggaactggcatcagtacaaacttagg

SEQ ID NO: 987 - DNA, 201 bp, Homo sapiens
ctgtattatagcaggcctgtggaggccttttgcatgccttaacactggaaacaggccttttccacgtgttcctgctgttcatgcatctcctttctgtaccstaagagagtggggaaggtgtactcacctcaagaaatgccttatggaatgcatctgagacatagaggtcatctcggccttctgcaacaatacctggaagga

SEQ ID NO: 988 - DNA, 201 bp, Homo sapiens
ggatgacatcccccttgtttcttaggctagggacccaaggggtagcttaggaaaggccttaccccaagaggtggggtgggagggagagcacttgaaatgaygtcttccaaacaggtctttgactgtaactaccagggagagggcctggtcttctcaaaggtgttggaggtcattcctgtgagtcctttggaggtcacaaaa

SEQ ID NO: 989 - DNA, 201 bp, Homo sapiens
ccatgtcttgcagctgctccttcaaactgaagccgtcctcaatgcggaagcggggcatgtggaccaccagcatcatctcctccaattcatccagccactcytgcagcacctctggggtgagttccttctctaccttggccaggctcttctcaggcttgggcaagatgaggaccatggtgatgtcatcacctttgaagggca

SEQ ID NO: 990 - DNA, 201 bp, Homo sapiens
tggttttcctgattttgctccaataggcactttttttagggggggattatgcttttgatcaaaagcttggtgctgaatctctcttttctccagagagattyagtctcaccctgctttcccaacacatggcgtttgtgtagaggggaggaccaaaggaacatgtgtggtttggaagcagtgttctgttctgttcttcttgta

SEQ ID NO: 991 - DNA, 201 bp, Homo sapiens
cttggggagagaagaggagcagggcaggatgagggcagtggcagcaccaaagaggaacctgaggcaggctgagtgcctggctggtgacaggggagaaaagragaacgggtctgcaggtggaaagaggtgtttaggtgtgccctgcctgtgaaagtagtttctaatggctgtataatattcagtagtctagaacttaaccat

SEQ ID NO: 992 - DNA, 201 bp, Homo sapiens
caatctatgacatttcatcttatcatgccctacttccctcccacaaaaggcagtggggggaagggggtgggaactaagtcactgagctgaaatgatccatmcttcccagagccagaaaacactctcacgtccttgaggcttctcttggctttcctgggcccctggtctcaatataccatcctaggccccgtgcagtggctc

SEQ ID NO: 993 - DNA, 201 bp, Homo sapiens
ggtttatggttcctgcgtgtacacaagggggtctgtgtgtgggtactggatcttcccatcttctcctgggagagaaagacaggcacccagtgcagattcayggacgtggtccgttgggcaagcctggggctggctggaagctggggcagctgagggggacttgccttcttgcgtggtctgagtccagttctgcagcccttt

SEQ ID NO: 994 - DNA, 201 bp, Homo sapiens
ccatcttctcctgggagagaaagacaggcacccagtgcagattcacggacgtggtccgttgggcaagcctggggctggctggaagctggggcagctgaggkggacttgccttcttgcgtggtctgagtccagttctgcagccctttcaagaacagaggtgcaaagccggagagaagcagcggcaccaagggagatgtggaa

SEQ ID NO: 995 - DNA, 201 bp, Homo sapiens
cagcggcaccaagggagatgtggaaggcaggctgaagaagcagagagagagaggagaggaccctgccattcatcttcccatctccactgccttcggttgcycactctgtccttcaactacatttggaaatgcaatttgaggctgagaggaccctgggagggctatgaagcacaaattaaaaccaagacagttgtgccacca

SEQ ID NO: 996 - DNA, 201 bp, Homo sapiens
ctccccagataactactgctgttggtccatagtttagtgtttacttgagaaccagaagttccacaggctgtacacggctattactctaacacagggttccrtgcacatctcatttgggggaacacgttaagtgatattcaaccgtcttctttactgtgggacttgtcagacctcagcatgtcagtgtgtactgttcatctc

SEQ ID NO: 997 - DNA, 201 bp, Homo sapiens
aagtaactcccaaatgaggttccagattcatttttctcatcccaggtagtaaacgtgttttaatgggtttgtttcttgcccatggcaacctcaacacagasgggagaactgttttattaccctaaaatagtgagaaccactgttcaaactaactagctaccaagtgacttctaactcatgaagaaaatttgtatttaagag

SEQ ID NO: 998 - DNA, 201 bp, Homo sapiens
caactgcttttcatctggttctcctctggatagtctctgtcaaacttgttcacaattccctccaaatccagtgcccagaaatgaacccagggactaccacmttttcctttgcctctatctctctctctcccccacccctctctctctatatataatatctatatataatatagatataatatatatacagcctccacagct

SEQ ID NO: 999 - DNA, 201 bp, Homo sapiens
ctggagggagatattgtcatccatccagtttcctctctataccaaatacaaagtacacataaataagcaaaacaaattttcaaagttccttctctagaatsctctttcttttgcatatgtagtttcagtggagatttctcaactagctgaaatggagcacttgaatatattaaaagagcccaaactgcttacagcaatttc

SEQ ID NO: 1000 - DNA, 201 bp, Homo sapiens
ttcggtcagcgattcattcttttcttctaaagatttttccaatttggtgttcagaagattattttttagtaagttattttcagagtcttgaatattattgwaatcttcattcccaaaagtatcacatgttgcaattatttctacatcttcagtttcaacatgcccaagcaattgaacctctgggctcttaacagattgtct

SEQ ID NO: 1001 - DNA, 201 bp, Homo sapiens
gttcatatattttttaataatgcattgtctagttcgaagaacttaacatcataaccattgctgtttatcccagtggcataccctgtatgaaatttcttaaragattatattaatgctacatttatggttttcaaaaatatttaaaagttgaaatctggctgagcatggtggtgcatgcctgtaatgccaacactttgagag

SEQ ID NO: 1002 - DNA, 201 bp, Homo sapiens
aaaagccacctaaatagtcaatttccacttctactcttattcgtctatgattttcttcccttcacagccagagtaatccttttaaaatgtaccagatcacrttactcctgaaaacactccctagctcacattggccctaaatgatctccccttatgtcttactctttctcctccatctacctaattcagtcattctagcca

SEQ ID NO: 1003 - DNA, 201 bp, Homo sapiens
gtcacggaaataattcatgggagtgctactaaagatatatgagacttcaactcttgaccacatcactttttctccaaaactttagaacttgtttgcaaaarctaaatggtataaaacacattttaaaatgtcacccaattctcaaatgtcactgaaagaaaatgcaggaaaagtatgtattgtgtgattaatcagcttagg

SEQ ID NO: 1004 - DNA, 201 bp, Homo sapiens
cactttacgtccactctctagcaattttcaaaaatacaatatagtcgaccctttaacaacacagggattaggagcaccaacccccaacacagtcaaaaatkgaaacagtttttactccccaaaacttaactgttattcaccagactccttactgataacagtgaattaatatattttttatgttatgtgttacatactgta

SEQ ID NO: 1005 - DNA, 201 bp, Homo sapiens
tgtgtatcaccacacttggctaatttttgtattttttgtagaggtgggtttcgccacgttgcctcaatcttatttctgatcatcattagtcttaaacattytgcctgaactcaagagtgagaaaagaaatgacaactggaagaaaccatcaatttaactgaggagtcaagcataaataaacatatatcaacacaaactgtt

SEQ ID NO: 1006 - DNA, 201 bp, Homo sapiens
tatagcaaataaatattaacatagtgaattaaatgaaattaaatgttagaatgtgtatgacagcctaggcataaggcatggcctgttagaaggctgaagayacttattcctgatcctgaaatccgaagtaaactgtaaactttgcttttagatggaagaagactgagggaaatgagaggatggagcttaatttataatgat

SEQ ID NO: 1007 - DNA, 201 bp, Homo sapiens
caaagacatcatgggtctaggtccagaccggagtaataaaacaatattgcaataaagcaagtcacacaaaatttttggtttcctagtatatatgtttataytatactgtagtccatgaagtgtgcaacagcattatgtctaaaaactgtacatacttgatttaaaaataccttattgctaaaaatgctaacaatcatctca

SEQ ID NO: 1008 - DNA, 201 bp, Homo sapiens
ttgtatcaaaataatctctaaacaaatagccccttacagctctgagattcctgtctcccaaaaagatccaaaaaccgaaacatcattctcccattttctgrggaataaatataatccgtcatccttgaataaatacgtttttgttttttatctcatttccccaagttattctagttacagattaactctagactgttcacc

SEQ ID NO: 1009 - DNA, 201 bp, Homo sapiens
ggctcatgggtaggctcttggagggggtattccatgaataccttgaaatcatatacaaagttttatgtctgtaaacgtgtatttttctagcagaagggatstgaatcattcttcacattcttaaagaatgccataactacccaaaagttaacatctaaggagcttacagtgttataaattagtaataggttgaattaatct

SEQ ID NO: 1010 - DNA, 201 bp, Homo sapiens
ctagctacttaggaggccgaggtgggaggatcgcttgagcccaagaagttcaagaccagcctgggcaacacagcaagaccctgttaaaaaaaaaacaaccyacaattaatattttatagtaagcactgtcttctctattttaagacccatatagtgaaatatacatgagaaactgagaaacctcaatcaagttacacactg

SEQ ID NO: 1011 - DNA, 201 bp, Homo sapiens
tattttctgattactaaaagatgttactgatgatgaatcaacagtatcatgtaactgcactgattcatcctatctctgctgaataaaagcacaggttttcmagaaaactgtctaagctctagttggtgccaaaggacgatagagagctaagtaactcctgaaaagtttcgatcttaacacactagccctattaccacatga

SEQ ID NO: 1012 - DNA, 201 bp, Homo sapiens
cctaactgtggtagtgaccacgtggttctcctcgctgtgtctcggggaacccccaacagggagcggaaacagggagagcagtctctggctccttctccgtytgccagccctgtctgccaccctcctggccatggtgaccaccttgacagggccaagaacagcccacctcaggcaccgagcacccgtgaccatggtagttgg

SEQ ID NO: 1013 - DNA, 201 bp, Homo sapiens
agcaaagttcagtgatttggtttgagtcacacagcatgagggtggcaaagatagggaagaattgagattttttgactcaaggatggaatgttttccctaasccatactgaccctttttgcaagtcccagtgtgagggtgtttctgatggttccagatgaagggaatttccatgcatgaagggaggcaggtcaaaggcagtg

SEQ ID NO: 1014 - DNA, 201 bp, Homo sapiens
ttcagatgaaatgcatagcttaacttgccacgtggtaaaaatgactggaatgggagaagtggattttctgacatttgatcctatagctaaaatggcaaaarctgttaagtacgatgtacaagctgtagctatcattgtggtggtattgaaactgctctttctattggatgacagtttcgagtggtaagtgtacgtcaattt

SEQ ID NO: 1015 - DNA, 201 bp, Homo sapiens
gttctctgtcctggagcagttccggctcgcgcgcaggcccatggctggagtccaagaggaggggctgagaggggtacgtggaggccgggacaccatccacrggccaggacagcatccacaggccaaggactgctgccagggcgccctgccaggctgaacccctggctcagccaaacgaggtgcccagaggtacccagcatg

SEQ ID NO: 1016 - DNA, 201 bp, Homo sapiens
agcgcagcgtcctttaaaggaaggccaaaaacaacccaacaaaaatgccaggtgatcaaagcggtcacagcacaatgtccacatccaacgagaaattgctrctacgtccagacgcagggaaaggtggccgtgggaacgtgagtcagcagcaacaggcccagaagggcagccacggtggacttgtcagacgtggaccctgaa

SEQ ID NO: 1017 - DNA, 201 bp, Homo sapiens
accctctggcccgggctggaggtggcgtaagcgcggcacgcggcgcagtggtccccgtcctggacgatgcagaagtggcctgggctgcagccacacacggygttctctgtcctggagcagttccggctcgcgcgcaggcccatggctggagtccaagaggaggggctgagaggggtacgtggaggccgggacaccatccac

SEQ ID NO: 1018 - DNA, 201 bp, Homo sapiens
cctggactgctggagtctgcattccaggagagcgggcagaccacagaaaagggagaaaaggggtggagggtcaaggcgggcggacacagggaacagggagyggggacagggcttactcagcaatcagagaagacctcacggaggaggtgaggtgtttaggtggttggtgaaggcggaagccccaggaatgggttagtgccc

SEQ ID NO: 1019 - DNA, 201 bp, Homo sapiens
acaccatctttctattatttgctgtttcatatttctgatttcccgttgtcctaccttctgtttgattatttctgtagtatttcatttcatccccatggttkccttcttagtgatacatctttgttttccttatttagtggttattgaagggtttgtgacatccatctgcacttatcacagcctatattcaggttgtgtgac

SEQ ID NO: 1020 - DNA, 201 bp, Homo sapiens
cctggggacaagtccgcacggcccttatctttgcgtctttgtacccaaaggtggcctcacctgaccccggtgtccaggtcccctctgtgtccctggttccygggcattgattaggatttgctgtgcagtgcatgcctctctatttacccctcttggggtctgttgagctttctgcatttgtgggatcacagttttcttgta

SEQ ID NO: 1021 - DNA, 201 bp, Homo sapiens
cctcacctgaccccggtgtccaggtcccctctgtgtccctggttcctgggcattgattaggatttgctgtgcagtgcatgcctctctatttacccctcttrgggtctgttgagctttctgcatttgtgggatcacagttttcttgtagtttagaaaactttcactgctttttcttcaaatgattttctgttcctgcctctt

SEQ ID NO: 1022 - DNA, 201 bp, Homo sapiens
tctgcccagatgggcaggacgccgagcttgcactgtcagttccagggcagggtcccgcaggcaggtcctcgccccacgtgcccacccagacacccacccckcaaacgggtttcccatctgtgcaaaccaggccattccaatggcagaggcaggtagggtgagagccccacttcttcaggtactggtggaggtggggtacaa

SEQ ID NO: 1023 - DNA, 201 bp, Homo sapiens
caggaaggtcctgggagggcttcgttgatgggagaaaccagccttctgcccagatgggcaggacgccgagcttgcactgtcagttccagggcagggtccckcaggcaggtcctcgccccacgtgcccacccagacacccaccccgcaaacgggtttcccatctgtgcaaaccaggccattccaatggcagaggcaggtagg

SEQ ID NO: 1024 - DNA, 201 bp, Homo sapiens
tctgccgtggcctcgttcctgggctggctgatgggcagtcgggggcccctgatggggatagtggctggacaggcaggagtgccacatgagcatggagagtrtccccaccccacccacctgggtccagccccctgctgcacactgatcttatcacctgtcaccaaggtcagggctgccggggagttgggtcacctgctcgag

SEQ ID NO: 1025 - DNA, 201 bp, Homo sapiens
gccatgcatgtggaaggtggactttcagcatgggtgggaccctagggggctgtggacccccggcccctgggactcacaggtgggagacaggagttccgacygccagggggagagtcctggaggatcctgggctgtcggcagccacccagcagggcccgtcctgggagtggggctggactcttcctgcaggaaaggctgggc

SEQ ID NO: 1026 - DNA, 201 bp, Homo sapiens
ccgggaaacacttctgaatcccacgtggctgcgaaatgaggacagtggaccctccggttctgtagacctgccattgacctccaccctcacagctctgaagmcccccgcctgtggtgagttcctcgaatggtgcatggggactaggactaataggacccatagcctgtgtgagcctctggggcaaagctcctgcagccgtgg

SEQ ID NO: 1027 - DNA, 201 bp, Homo sapiens
agctcaaaaagatgagcagcacttatggttttgctgtgtatcacgctcagttctaagcacttcacaaatattaacccacgcaaccctcacaaccaccttasgagataagttgctattattttccgcattttacacttgaaactgagaaagagaagtgaagtgacttgcagaggtcccaaagccagtaagcggtggatggag

SEQ ID NO: 1028 - DNA, 201 bp, Homo sapiens
attacacataggggcccacaaggtcctcccaggcccggccccagctgccacttagccgcaaacacttactctagggctgcagcttccgcctctgtctccgmtgcctccatctttccaggcgccgagttcagctgccttcccacaatccctaagattactttgaagtcacagtcgacttcgcgccggggcaggcgattggct

SEQ ID NO: 1029 - DNA, 201 bp, Homo sapiens
catgcagccagaatcctttactagtgggtcccaggacgtgcaccagaaaaaagtcttactgttaacagtcccaggaatggaagagaccatatcagaggcaracaaaaacctttccaagcaagcgtggggaaaccaagaagacgggatccaggaccaagtcctgcgcggaatcaacgaatcaacatcttcccgtccgccgac

SEQ ID NO: 1030 - DNA, 201 bp, Homo sapiens
gttctcctggtgaagaagtcgcccagactccaaaacatcttgtcagaggggaaggacagaaagcaaaattatattgtgccccaataaaaggacacagttakgttttttggtaccaacaggtcctgaaaaacgagttcaagttcttgatttccttccagaatgaaaatgtctttgatgaaacaggtatgcccaaggaaagat

SEQ ID NO: 1031 - DNA, 201 bp, Homo sapiens
ttcagctaagtgcctcccaaattcaccctgtagccttgagatccaggctacgaagcttgaggattcagcagtgtatttttgtgccagcagccaatccacartgttaaatattagctaatcttaggacacagactcatcacggactcagctcaggaagcaggtggtatactaggttggaaggaaataacagaaactagagct

SEQ ID NO: 1032 - DNA, 201 bp, Homo sapiens
atcaatcctaagctccataccaccatgtactttttcctcagtcatctatcctttttggatacttgttattccaatgtatttacacccaaactgttagagaytttggttgtggaagacagaactatctccttcaaaggatgcatggtacaatttttctttggttgtgcatttgtaatcacagaaatgttcatgttagcggtg

SEQ ID NO: 1033 - DNA, 201 bp, Homo sapiens
tcatctatcctttttggatacttgttattccaatgtatttacacccaaactgttagagattttggttgtggaagacagaactatctccttcaaaggatgcwtggtacaatttttctttggttgtgcatttgtaatcacagaaatgttcatgttagcggtgatggcttatgacttgtttatggctgtttgtaaccccctgct

SEQ ID NO: 1034 - DNA, 201 bp, Homo sapiens
tgctgccaacatacgggctgcagtggggaggcacagccagtcctcccactccacagagcaggcaggagtcccgcccctgggccccaggcctcctgctccargggacaagtgcaagccctgccccttccgaattggcagggcaggagctcctcatgggcagctgcagtcacccaagcccggctgtggacctgggcatctctg

SEQ ID NO: 1035 - DNA, 201 bp, Homo sapiens
gaccccagggcctgaggacaggtccccaagtggacgtctcaaagagagtcccacattccagggcacatgggaactatggccttctggcagctggagggcascaggaagggcacagctgtctgagacccgtgtggcttcccagaaagaggtgccacccctgaggaggcaccggtgctcacggactcctggttgccagtcttg

SEQ ID NO: 1036 - DNA, 201 bp, Homo sapiens
ggctcttcggtgcagggacttgtgaagaaggttttgattcctttattcagagggcagcaggcaccactataatcttctattactttatagcgaacctgtcrtcagtgatcagaagaaacctttaaatattcacccatgatatctgagttttaagtctgaatttcaaattttaaagcaagatccaaaatatccagtgacaag

SEQ ID NO: 1037 - DNA, 201 bp, Homo sapiens
tcacagagtaatacaggttgagtatctccctatttgaaatgcttgggactaaaagtgttttgaattttgcatttttttccaattttgtaatgtttgcattrtaaaacagttgagcattctgaatctgaaaatccaaaatctgaaatgctccaaaaagcatttccttggaacatcatgttggcactcaaaaagttttggatt

SEQ ID NO: 1038 - DNA, 201 bp, Homo sapiens
ttcatttatcatcaatggaatgtttcaggttgtacattataaatctgatttgcaggtgtaatctcctttggacacctgttagctttgaaaacttttaaaamctcttccttcttgcaaggcaatcaggtacttagcagagagagggaatgacctctggttctattttggcttccagctgatatcgccatggtgatctgtgac

SEQ ID NO: 1039 - DNA, 201 bp, Homo sapiens
aagtgaattgtcacatctgctccagtaagcagtgtggtctaggtatcaaaagcctgactgttctgagcccctattcccttcccttattatattttaggggytctattctaaggaaatggtctaaatttaaaaggatcaatttgaaaatatttagcgtaatttaaagtgtcaagcttgaaaacaatctaaatacccacgatg

SEQ ID NO: 1040 - DNA, 201 bp, Homo sapiens
ctaactagagtcagggggaactcggtatgggtgtttacttatatgtgtatgatcaggaaaggtgtttttggcacaccatcacactgtcttttccagggaastatcttcttgtagtctttgtaaatttcctttttagactttttctaacatatatatttctttcttttttttttttgagatggagtcttgctctgtcaccta

SEQ ID NO: 1041 - DNA, 201 bp, Homo sapiens
aggattgcaggagctacaccaaagaatgggaaagtctagaagcaaacgggagacagaacccaagaagaggaatgaggcaactctgactcaactcccaaggrgccccagaaccccaaattcttcacacatgtcagtccagttctccactatctaactaggccaagtgccccaagacaccatccctgcctagcccaagaccag

SEQ ID NO: 1042 - DNA, 201 bp, Homo sapiens
cagaattctggggagacattgccaaggaattttactggaagactccatgccctggcccattccttcggtacaactttgatgtgactaaagggaaaatcttyattgagtggatgaaaggagcaactaccaacatctgctacaatgtactggatcgaaatgtccatgagaaaaagcttggagataaagttgctttttactggt

SEQ ID NO: 1043 - DNA, 201 bp, Homo sapiens
ggccaatggtgccaccagtgttttggtgagaagggagccacctggcctagctgggggatggacaagattatcctgggtgactacctcccaaggctgcttgktctagagggagggggacttatacaatcatctgttttctggagaaagagaagtcctgagggggttgcgtatcctgactaggatggtatcttggcttgtctg

SEQ ID NO: 1044 - DNA, 201 bp, Homo sapiens
gatagagataaatgctgttaagaaaaataaacagggtagcatgatagtgtgtgcagggatggctactgtacacaggatcgtcggagaagacttctctgaaktgacatttgagcagaggcctgaagggtgagaaggaaacaggcatgggaaaatctagagtaagagtgttttgtgcagagggacacagcttgagatgtctga

SEQ ID NO: 1045 - DNA, 201 bp, Homo sapiens
tgtgcagagggacacagcttgagatgtctgaagaatggactgaagcctgtgtggctggagcgtagcaagcaaagggaagaatattacatgacgttggagaygtacataatacagggagggtcttgtgggccatggtgaggagtttgaattttattcaaagtacagtgggaaaccttttttttgttgttgttgttgttgttg

SEQ ID NO: 1046 - DNA, 201 bp, Homo sapiens
cgtagcaagcaaagggaagaatattacatgacgttggagacgtacataatacagggagggtcttgtgggccatggtgaggagtttgaattttattcaaagkacagtgggaaaccttttttttgttgttgttgttgttgttgtttgttttttttttgagacagaatctcactctgtcacccaggctggagtgcggtggcacg

SEQ ID NO: 1047 - DNA, 201 bp, Homo sapiens
tcttattgttaccttcatgctaaagatgatgaaactgagactcatggaagttaaatcacttgcccaaggccacactgctagaaaggtggcatttaaactcyagcaggctcattctacagcctgagttccataagataaaatgagagagtaaagagacaagtgtgttgagagcaagagaagcagtgaacctgaggctgtctc

SEQ ID NO: 1048 - DNA, 201 bp, Homo sapiens
aagccagttcacaactgttatgtatgtcccatcttggttgccttccctcctgggctcctgccagggactctcattcctccctgtgatccagtaagagcatyagtgggtggctaaggattgaaacttcagggttccacctgtagagactggtctagggggaccctgattacagaccagtcacttccctgctctaatacatct

SEQ ID NO: 1049 - DNA, 201 bp, Homo sapiens
atacaaatgttggctcgaaattaccgagcagcagaatcatactgccatgtgtagtaaaacacactttatatttccactgcttaaagcagctgaaaccagamtgaaaaaatttttaatggcaggggtgaaggtgaaaacgcaaacatgtaaaatgatgagtctgattaagacacaggctttttaaatgtcttttccttttct

SEQ ID NO: 1050 - DNA, 201 bp, Homo sapiens
aaaacatgtcaggcagttccaatctctaggtcaagagagacaggcattctctgttgagctggaagaggaaactaaggcccaggacagggtaggtgtgcctrttgtcgcttggtgagtcagggctgtattaggaccagaagtctcactcctgactactgaataaaaggcctagcttcaggctgatatccatcatgacacatc

SEQ ID NO: 1051 - DNA, 201 bp, Homo sapiens
gttgggatttgaaccaagacagtttgactgcagaatccatatcctaatagcaatgctattcctcttccatgaccccacagaatgcatttcaccaaattccrtcaaatacagaatttctaccagggaagcagcctcctaatttgtcctctcttgcctagtttcgccaacttgagtctttccagtagatttatcaagacacca

SEQ ID NO: 1052 - DNA, 201 bp, Homo sapiens
aagctaagtgatttgcctaagggtcatacacctgtttgaagacagaactgagactaatctccagatactctcactcctagtcaactattttttttcactcrtgacactacctcattattctagtagtccagcacttggctgtgacagataaaaagagaaattagccacattagccaaactgatttaaattaactttaaaat

SEQ ID NO: 1053 - DNA, 201 bp, Homo sapiens
ggaggttatagtccagcttgaggagacagacaataaacatagaaaccagtaagtatatgacaggtagtgatgagtactatagaaaaatatagagcagagtsaggggaaagggaagtgacagtgcagagtgggagctgataaggaaagaaccttttgataaatatgacatttgagcagagatctgaaggaaagtatggagtg

SEQ ID NO: 1054 - DNA, 201 bp, Homo sapiens
tgcctgagggttgtttgtggctggtagcataaatactcaaagctaatgggagatacatgggaaatacctgttgttgggaacagtctttctccacttgaatsaggtgagcagattgtggaggtgagctggaggatttcatgtttaaggtggatttctaacctgcttctctcatttctccctgagttttatgacccttgacac

SEQ ID NO: 1055 - DNA, 201 bp, Homo sapiens
agtattccagctatggtctgacttgaacagggtactattaccattctttcactttacatatctaagattatattagcctcattgacagccacactctccastcagtttataatctctcataatacttaagattttccttttctttctctctttctctctccttttcctttttcctctttctcctttcatttccttcccttt

SEQ ID NO: 1056 - DNA, 201 bp, Homo sapiens
ctgcaaatttagctcatataatttatagaagacatctaccatacaacctgttttgcatagccagttatcacccaacataatcagccaaatcagatctactktgttagaaattgcctaacttctttcttaagataaatatgttaatatatgactctgtgataactgtttcacttctgagttgtaattctaagagatataagg

SEQ ID NO: 1057 - DNA, 201 bp, Homo sapiens
tttccttatgctaattctgaatttggaaacaataccccccttttggaggccatgtcatttaggaggagaaggccctgaactagacatttagactcaagaaytgtgctatccaacatggaagccactagctacatgtaactattgatatttatagtaattaaaattaagtaaaataaataatccagttcttccgccacattt

SEQ ID NO: 1058 - DNA, 201 bp, Homo sapiens
agatgtgaagagaggtagtctaattctaaatggattttgaatcaataatgggttaaagtaaatttcgagagtgtgagaatgaagtagttggagaagactcyttggaggaggttccctaggggaagaagatgagaaggactagtgactgtgtaccatgggttgtcacaccaaccatatggcctccaggtgaaggaaaagtag

SEQ ID NO: 1059 - DNA, 201 bp, Homo sapiens
ggcgtgagccaccgcgcccagccccacactcttaagtttaactcccagtagtcactgaactaacctctgtctctcctgacattcatcagtcttcctcatcycaccccaacctctacccttggggcaatccaaggcttgatgtttactagataatacttttttcttttggtgtttaccacatcctgtgagtctgttaaggca

SEQ ID NO: 1060 - DNA, 201 bp, Homo sapiens
ttcctgctgaatggaacctgtcccctcaagcaaaagtctctatgggaaaccctattggtaccagtggtgtaaaggcaggagcagagctagggtaggaaacmcgcagatgtggattgggtctggacatgtaggcaaaagtgcttggaccaagatctgttgacttattttactactaacagggtcaggtgcccacctcacctg

SEQ ID NO: 1061 - DNA, 201 bp, Homo sapiens
tgatcaataataatagcagggttgggggtagcaatctatcagatactgttcaggtaaaggctttccaagaaggtgacatttcagctcagaattgaaggatrggaagggaccagccaagggttcctcctcagcctgaggccaggtgagaggagttctggggtagagatgggggtaggatggcagggtggttggagtactcag

SEQ ID NO: 1062 - DNA, 201 bp, Homo sapiens
gctagttgaaggaacactggaggactgtcggggatttgggggattaagtaaaaggtttataaggagagggtggaaagagtggttgatggctgatattctgrtcatttatactagctactcagtctctactttttctagaagtccccagtaaccaaagcccaacacatttggtatcgttgattccttccattgtttgctttg

SEQ ID NO: 1063 - DNA, 201 bp, Homo sapiens
aattgtgtaacctgaaacaaatgacttagcttctatgaattttatttcttatgaaatgaaatgagggggtgataatctgtaaggttacttccattgttacrgttctaattgcttctctttcctccaaatttttttttttttttttttttttttttgagatagagtcttgttctgttgcctaggctggagtacagtggtgca

SEQ ID NO: 1064 - DNA, 201 bp, Homo sapiens
taaaaagatatcctgtctgccattaaggaactcataatccagtgagggaaacagatgtctacataggactctagtgctagaaaaaaataagtgcccaagtkttgtctttagaaataaacaggctgggcgtggtggctcacgcctgcaatcctagcactttgggaggccaaggcgggcggatcacttgaggtcaagagcctg

SEQ ID NO: 1065 - DNA, 201 bp, Homo sapiens
ttatacaagtgagcgcacataggtgagttggtatgtggtttgcatatggggacacatgtgcttgggtatgtatatgttggcattcagccataaccggagaygttctgaagttcctgtggcacttgtcagtgagccagttaaggaaatggcttttctgcctctggcattcagggccgtttgccagcttcctctctccctgtt

SEQ ID NO: 1066 - DNA, 201 bp, Homo sapiens
taccattgcttagttgggggccagtttgtcactgaaattcactgtccattgtgtctgttgagactctctttagcttctgctctagagctttatgcttgagytccagccaacacttgggctcatttcccaggctctttaaagatcagaaaacctttaaagatcttcaaaggaggccgggcatggtggctcatgcctgtaatc

SEQ ID NO: 1067 - DNA, 201 bp, Homo sapiens
gaagaggaagtggtagaaactacggcaaactggacagtgcatgcccatcatgggaagcagcttctattccacgccaggtaacttcagccatgtgagaatgygggcccaagttgttatcggatttcccgattgttcaagagatgttggaaatctggatttttatgaaaattctcaactttttaacaaaagcaaacaaaattt

SEQ ID NO: 1068 - DNA, 201 bp, Homo sapiens
tggtcaacaagagcaaaactctgtctcaaaaaaaaaaaaaagtctacctctttaaacactactttccttccttgttatctcaaactcttctaagttttctytgtcgtgttttgaaatctagacccatttcttttttttttttttgagacagagtctcgctctgtcagccaggctggagtgcagtggcatgatctcaactta

SEQ ID NO: 1069 - DNA, 201 bp, Homo sapiens; identical to SEQ ID NO: 963

SEQ ID NO: 1070 - DNA, 201 bp, Homo sapiens; identical to SEQ ID NO: 964

SEQ ID NO: 1071 - DNA, 201 bp, Homo sapiens
ttcatcactattcatagatgcctgtcactattcagaaaaagaagaaagaaagagccatactttcaaagctattttctttttctatatgtcctagtagaggygaatatagaatttatcactttgaagccaatgtagtctgaatcaaccggtcctccatctccagatctaagaatgcaagttaaatgttctctagaaattata

SEQ ID NO: 1072 - DNA, 201 bp, Homo sapiens
ccttccactgaatttactactaaacattgcaatgtttctttcaaattataagaaagttactccatacaaaaagaaaaaaggacacaactcattattctggktttttttaattttagattcagaaggtacatgtgcaggtttgttacatggatatacagcatgatgctgaacacctcattattttgacatcaggccttcccc

SEQ ID NO: 1073 - DNA, 201 bp, Homo sapiens; identical to SEQ ID NO: 965

SEQ ID NO: 1074 - DNA, 201 bp, Homo sapiens; identical to SEQ ID NO: 966

SEQ ID NO: 1075 - DNA, 201 bp, Homo sapiens; identical to SEQ ID NO: 967

SEQ ID NO: 1076 - DNA, 201 bp, Homo sapiens
caatgaggaacataaagaacttccaagaataccacagtattagcatatttggtcaaaaaaagataaattccagatacatttacaatgtaacagcaaaaccmagtaagtagaaagaggaaaagagctctgacgaagttcactcctttgcctccatctctgcccacttctcctggtgctctttctcacgggaagaggtggagc

SEQ ID NO: 1077 - DNA, 201 bp, Homo sapiens; identical to SEQ ID NO: 969

SEQ ID NO: 1078 - DNA, 201 bp, Homo sapiens; identical to SEQ ID NO: 970

SEQ ID NO: 1079 - DNA, 201 bp, Homo sapiens; identical to SEQ ID NO: 974

SEQ ID NO: 1080 - DNA, 201 bp, Homo sapiens
tcttgtatagccatagtatgaatatcaaaacaaagaaattaacatcagtgcaatactattaactaaactaccaactttatttcaatttcaccagtttttcyaccaatgcccctgcctagtccaggacccaacccaggatcccacatcgcagttaagtcatcatgccactttagtctctccaatctatgagtgttccatcat

SEQ ID NO: 1081 - DNA, 201 bp, Homo sapiens
ttgtaaattagtcacctgattctcacagaaaacttgttaatttctgctgtacgccaaagccactaatggatgaaacttacgattagttccaacatgaataytggttgacatttttgtttatgttaaagtcaaagctgaaagtgatacaatggagacttcagaacttcacttgtcagttatgtgagtgatttctttgctaaa

SEQ ID NO: 1082 - DNA, 201 bp, Homo sapiens
aaagggtaacattttttgcccagttgaagtggacaggcattacttgacagagggtcttgattcagtgtgtatatgaagaaatggtagatttttaaatcttytttcctgtgcttagtgggcacaaaattgtaacaaaaattactatgtttcctcctgttcttgctgatggctagcataaaattaaactttaaaaatcctagc

SEQ ID NO: 1083 - DNA, 201 bp, Homo sapiens
ttgctcccactcttcctactacacacctccattactatgattattagagtgtattctattaattacatcatgtttgcctccctcctaaactaccttctcaytgagggcacagaccatgtgttttccatgttctattctgtgcagaacctaacatagccctggcacatgtaagtactttgtaactctttgttgaatggatat

SEQ ID NO: 1084 - DNA, 201 bp, Homo sapiens
agaacaatatttgaagcctctatacaacttttataaaacatttgccacaaggcaagttttggtgtgtgcaaaaatccatttgtagaccagctgtgacagamtctttaaagcatatccaaggcaatgataaatgaagcagacattcatgccaaacgcttggatttagatttacgtatcaagaaagctttaataagtaatcct

SEQ ID NO: 1085 - DNA, 201 bp, Homo sapiens
agaaactcaaatttaaaagtgctgctataataaagttgctccttcaagtatatatggggcggcagagaacaccagagcctcgcgggtcacacaggacaccrtgagtaagcctgtagatggcaccaatccacgaccaatctattgtttacagaaacagtcattttgggttgtgcttctttatgcaagatatttaacaccttt

SEQ ID NO: 1086 - DNA, 201 bp, Homo sapiens
tgcatgcaagaccaacagagtggcccaaactacaaaatcatgagatatttacatggctattgttttaagacattaaatttgaggtagtttgttccacagcrtgagggttaatactgagtgtcaatttgattgtattgaaagatgcaaaatattgatcctgggtgtatctgtgagggtgttgccaaaggagattaatatttg

SEQ ID NO: 1087 - DNA, 201 bp, Homo sapiens; identical to SEQ ID NO: 975

SEQ ID NO: 1088 - DNA, 201 bp, Homo sapiens
gaattacccaaaatgtgacacagaggcacaacataagcacatgctcttggaaaaatggcactgatagactggctcgactcaaggttgccacaaatcttcamtttgtaagaaatgcagtattagcaaagtgcaataaaacaagctaggcctgtactttaaatcatctctagattatttaaaacacctaatacaatgtagata

SEQ ID NO: 1089 - DNA, 201 bp, Homo sapiens
aaaaattatagcttacacagactaaataacctccctacagtggatccaagagatagtgatagggccagaatttaaactcaacttttaaccagtactgttcygctgatgtctctgatatgtctgagtgcctaaatgtatcatgagttgtgctaagtgcaataaaaaaagataaggtgcccttaaggaattcgtatatctaat

SEQ ID NO: 1090 - DNA, 201 bp, Homo sapiens; identical to SEQ ID NO: 976

SEQ ID NO: 1091 - DNA, 201 bp, Homo sapiens; identical to SEQ ID NO: 977

SEQ ID NO: 1092 - DNA, 201 bp, Homo sapiens
agttccaaatattccttagatgaaggccaaatgaactcctttgacttccatcatgatataatcactttggactccagtctttcttctgcctctctcatacrcggtattgggacaagttcatctctaccctcttaactctatatttcacatctaaagataaatttacacaaacatattgactaacaccattggaatctccct

SEQ ID NO: 1093 - DNA, 201 bp, Homo sapiens
ctgtgcacgtggtaactaattgactgatattcatatataaagtaggtactttatattgcagtttgacaaatttagtctaattccatcatcagaaagaatgrggcagtggaactcatttaatgagcttcaatataccaatatgttggctgggcatggtggctcatgcctgtaatcccagcattttggaaggtcgaggcaggc

SEQ ID NO: 1094 - DNA, 201 bp, Homo sapiens; identical to SEQ ID NO: 979

SEQ ID NO: 1095 - DNA, 201 bp, Homo sapiens
ctgaaaagggaaatggtccttcccctcctttaaatgccaagtggcactcctccatagatgacatagctggtaagctgcatatgcaaaccatgctggattarcttcatggtcatcaggatgtttgttcatccttaatatgccctttaaatcatggtaaatactgtgactgaaggggccccgctaggcaggcatctgatataa

SEQ ID NO: 1096 - DNA, 201 bp, Homo sapiens
gagcaaatttacaagactcaggcaagctaaataacttgccccaaaacacacaactgtgagtcattatataaggatttattccaagtctatctcaatcccartcccatgctcttctgaagagaatacactgctaggaaaaatgccttaaaaatcagtaatcatctgtcaaagccataggaatgtctgttccctcttctatac

SEQ ID NO: 1097 - DNA, 201 bp, Homo sapiens
gtgtgaaagagcaagaaaaaaaaggtcacaaaagggtcctagagacaaacttttcctactttgtagtatttcttactattagtcccatctaacagaataasctctacataaattcattgaaaattcataaattcattagtaaaccagtatatcaatttaagtttattttttacactgtgaaatataaacacctgccatagt

SEQ ID NO: 1098 - DNA, 201 bp, Homo sapiens
aactctaaaattcagctttaatgcaggtatcaaaaacttcaaaaaaacaaattccctatgtggaatcaaaaagatctttcaggttcattcgatgatttttyactttgctttgtttctgtttccatttagccctattttaatgcttattttactaaactcaaacatagggagtactttattttctaacatgtttgtctccgt

SEQ ID NO: 1099 - DNA, 201 bp, Homo sapiens
ctaggtagtctgcaaagatggctgccacaaattcccatttctccctgtatgcacattccactcttcccatgaaggggtggagtcaactttctctctccccrggctaaccctgtatcttgctttgaacacagaatatgatcaaactgatactatgccagtaacagacaaagcctttaagcctggcagtttatgcgttctctc

SEQ ID NO: 1100 - DNA, 201 bp, Homo sapiens; identical to SEQ ID NO: 980

SEQ ID NO: 1101 - DNA, 201 bp, Homo sapiens; identical to SEQ ID NO: 981

SEQ ID NO: 1102 - DNA, 201 bp, Homo sapiens
cagcctccagaactgtgagaaaacacctagactatgaaattttgttatggcagcttgaacagactaattcagatggaaactattatttcccccattttacrgaagaaaaaattatagcttacacagactaaataacctccctacagtggatccaagagatagtgatagggccagaatttaaactcaacttttaaccagtac

SEQ ID NO: 1103 - DNA, 201 bp, Homo sapiens
ttctgagaaatgcatcattaggcaatttcctcactgagtgaacatcatagaaacacctagtttttaggctacaaatctgaacatgttactgtactgaataygcagttctaacacaatggtatctgtgtatctagacaaatctaaacatagagaaggtacagtaaaaatacagtacacagggtaaaaaaaaaagtggcacac

SEQ ID NO: 1104 - DNA, 201 bp, Homo sapiens
caattatatcaatgtttgttttacggctaaaaaactgaaaacttcactggtaagatatgaacacatgtttagatcctatgcttttctagaaatgttttgtraatcacaaactaacaaaaaaacattttctggaagaacaacaaattctagttttcatcatcagcgcaaagaatgtcatatttttacttgtttgaaatgagt

SEQ ID NO: 1105 - DNA, 201 bp, Homo sapiens
tatatatatatatataacatttcccaacataccttagaaataccttgtaaaattatctttttaaaaatgtactaaagggggctagggcaaaggaaaaagcratggtgaagtaaccctctcttgcaccaattgttccttccttaattcctcataaagacattcttcattgccctctgcctggaatattcttcttctctgttt

SEQ ID NO: 1106 - DNA, 201 bp, Homo sapiens
tgttagttcaagacagaactaagagtccctactaaagcttgaagtaatctgtctttagaagaaagactgtgactccacccaggaaattgggcataattacrttaagaaggaatggcttcatccagaaagtaccactaataattttctacaataaatctccattttggcttaacagaaataaacttggtcacccactactag

SEQ ID NO: 1107 - DNA, 201 bp, Homo sapiens
gcggagctgggaccatcttactgtgccagagagtaagaaggtgctcagagaatgatggggacatgttaaagggcacagaagtttgaagggaatcccgctgrccacatctgagacaatctggatatcaaaatacataatacgaaaacactatgactcatttgttgaataaaacaagaatccatgagcccatattgataaaaa

SEQ ID NO: 1108 - DNA, 201 bp, Homo sapiens
aatatcataatttagacagaggaatgcttatcttcagtgagtaaaagaaaataaaccctgacctagaactgtcttactcagtaaaaacatcctttaaaaawatggaaaaaatgaatgcattttcgcacaaataaaaactaaaagaccatcaatggataaatggataaacaatatgtggcatatacatacaatggaacatta

SEQ ID NO: 1109 - DNA, 201 bp, Homo sapiens; identical to SEQ ID NO: 982

SEQ ID NO: 1110 - DNA, 201 bp, Homo sapiens; identical to SEQ ID NO: 983

SEQ ID NO: 1111 - DNA, 201 bp, Homo sapiens; identical to SEQ ID NO: 984

SEQ ID NO: 1112 - DNA, 201 bp, Homo sapiens
aaaatcgccattttaaagtatacaagccatagtttttattacattcacaaggcagtgcaactaccactactaattccagaacttttcatcgccccaaatayaaatccagaactcattagcagtcattctccattccctcatcccctcatctcctgaccatgaaaccactttctgtccctaaggattttcctattttggata

SEQ ID NO: 1113 - DNA, 201 bp, Homo sapiens
gaaaacaacataattgccaaaatttgttttataaaaggcatttcccccatcacataacttcaccatttctagtaatcatcacacccccagaccaaagcacraagttaaagaaggcccttataatacacataaaaagtcaacaacttccttcagactaagaagaacaaattctaaactagagaaccctggatgagaatgacc

SEQ ID NO: 1114 - DNA, 201 bp, Homo sapiens
taatacatacttttgattgaatgagctaatcttatttggggaacatacctgttcttgaagatttagttcaaatgcacctttcctcctaaaatctcctgtayaggagaacatttgtggggatgttatttttatcgtggtgatgatttcatgggtcaaaagttatcagattgtacactttaaatatgtacaaattatttataa

SEQ ID NO: 1115 - DNA, 201 bp, Homo sapiens
tggtgctctttctcacgggaagaggtggagctaatgttattagtcaacttctacattggttacgtcgcttctcccttttaaataagcagattcatgcagtrtgagatcatgagatttcagcaggtctggccattgttctttttttccttctctttttctctggatactggccactggtatgagttactacagccaggaatt

SEQ ID NO: 1116 - DNA, 201 bp, Homo sapiens
tcactggcctggaagcttctctgaacactttgcaggccgaggcatggttgtaacctgtttgtagcacccagtctgagaagctaggcttgaatgtaggccaractaaatatttgaaagtttaaaaacaccatatatatggtatcattttaattaaacgactgacattgtgattaaacaaaggaatgaaaatagcagttccta

SEQ ID NO: 1117 - DNA, 201 bp, Homo sapiens
  misc_feature (1)...(201): n = A,T,C or G
tattttttcttaggcctactgactttttcattctggttccacccatgtggacttcaagtaacaactcagagctagggtgtgctgattatagagcacataangtgcactgtacattcttgccttaagaagaactaagtaatacaaattaaacagtgaaagacagtagtaaacaaaggcaatgtaatggagaagtctacaggg

SEQ ID NO: 1118 - DNA, 201 bp, Homo sapiens
gaatgatcgggttcaaaaatgctgaagtgaggaaaccattccatgaagtcaagaaccctattttgacttacagtcttccagcagagcagcttgatatgtasgaaatcatcaataaatatttgccaaattaataaatgtatcactcaagtcctttttaattattattggtttttttggagacagagtctcgctgtgtccccc

SEQ ID NO: 1119 - DNA, 201 bp, Homo sapiens
gtgtctttaaactgacaaaatattcacattgaaaataatcttatagatctagtccaatcccctcattttaagatgaagaaaacactgagcccctaaatatycatactaaagtcatactaaagcatcacaatatcaaccaccacccaattaattttaatccaatcctaactgcagcttctataacaggtcctttactcttaa

SEQ ID NO: 1120 - DNA, 201 bp, Homo sapiens; identical to SEQ ID NO: 985

SEQ ID NO: 1121 - DNA, 201 bp, Homo sapiens
atttatttgttagcatatatatatgtgtttgcaatatccactcaaaaccaaattttaccaatttataagcacatttaaatgaaaaagaatcagactggcaytggctgtctcattagcaaccatggatgctgaaaataatttaagcagttctcagatgttggagaaaatgattttgaacctagaattcctcagcgaaattat

SEQ ID NO: 1122 - DNA, 201 bp, Homo sapiens
aaaaaatcagggaatactacataacaagctatttgtgctaggtagtctgcaaagatggctgccacaaattcccatttctccctgtatgcacattccactcwtcccatgaaggggtggagtcaactttctctctccccgggctaaccctgtatcttgctttgaacacagaatatgatcaaactgatactatgccagtaacag

SEQ ID NO: 1123 - DNA, 201 bp, Homo sapiens
aagctctagaaagccagctctaatgctgtcagttagtccatattatcctgctggagagagaggccatgtggagagaccctggaagataaattaccactccragagagagaccaagtggaggagaaccaagacaccatagccaacagtcagcaccaaggccccagacacataaggaaggttttgttggattttccagcccac

SEQ ID NO: 1124 - DNA, 201 bp, Homo sapiens
gagaggccatgtggagagaccctggaagataaattaccactccgagagagagaccaagtggaggagaaccaagacaccatagccaacagtcagcaccaagkccccagacacataaggaaggttttgttggattttccagcccacccatgtataagctgtaggcagctgattgagagccatgcatgcaagaccaacagagtg

SEQ ID NO: 1125 - DNA, 201 bp, Homo sapiens
acaggacaaacactgtatgattccacttatgtgatgtgtctaaagtagtcgaattcacagaagcagaaagtagaacggtggtttccaggggctgggggtaygggaatggagagctactgttcaatgggaacagaggttcagtcatgccagatgaaaacgttctagagatctgctgtacaataatatgcacatagttaacaa

SEQ ID NO: 1126 - DNA, 201 bp, Homo sapiens
cagtgaaaaacttaccaacaaagacaaaactccaggtctagggagagcttcactagtaaatcccaccaaatatttcattaataaataatacaaatcccatrcaaacaattcaataaaattaaagagaaaggaggagtacttccccttttgtttttaaaaagcaaacatgatcctgaagtgaaaattatacaaagacatttt

SEQ ID NO: 1127 - DNA, 201 bp, Homo sapiens
tccttatccactacccttgccactactgccttggctctagctacctcctagatatagttatggttcccaatccatgtagtcagttactgtgtttcttttamgcattcattctattatttccagctgctcacttgacatttccatcttggttttatatagaaacttcagactcagtgtacccaaagttattatcaacatcta

SEQ ID NO: 1128 - DNA, 201 bp, Homo sapiens
aatgactttgagcaaatctttgtatcaaaatagttgtcaaaatattctcatctatttcagctattttaaaaatgttacattatatgcaagatattaaagayagtaggtttcaaagaaaaaatcaggaaaattttggcaagcaaaacattttctaagaatggggttctaaaaaactaaaaagaatgcatcaaatactgcact

SEQ ID NO: 1129 - DNA, 201 bp, Homo sapiens
attacagatctgatacacaactactacttctagtactgtcacgaaaagcccagcattaataatggtaatgtactagaaatttcaaggtccaaaaaaagtgmgagacaccatctgaggtaaaaggaagaggctggcttcagctcctgccaatcgctccctaacactgaccatgtaaatctgatcacagtatcgccttgctct

SEQ ID NO: 1130 - DNA, 201 bp, Homo sapiens
atgcttaatggatgcatccactaacaaaagtagtgatgaagtcaaatatgaagtcataagaaacaagattgtatattaaaaatctaagtaatgcttactayttctatcagagggttgttatctaaaaggtcatgcttttgaggagagagaaaaaaaaaaacactagacataatacatcatagaatttccaccaaaaaaaag

SEQ ID NO: 1131 - DNA, 201 bp, Homo sapiens
agttgccatcataagtaggactcattaaagcatggcaaaaacattgtttcaaaaaaggaagaatgacagggcagacaatgacaaactctgatgcctaaatrggtatacagtcaccaatggcatgagacggcagctgtactgtgctgttactacatatagaagttgtcaatggaatttagaaatgacagaccaaaatctcaa

SEQ ID NO: 1132 - DNA, 201 bp, Homo sapiens
aaataaaagaattaaaaataaaggaaagttaatactattttccactaagaagaaccagagctccctagagagctgcttctagaggtaggaaagtatatgamgagactggaatatcttgttgtcccagcaagtcctcaaaaattgatggagacatgtcaaaagaatttaaaagccggcctgaaagtgctttcatgggcccaa

SEQ ID NO: 1133 - DNA, 201 bp, Homo sapiens
gatcacttatctctgtaggaagaaaagcaatggccattcctagcatactttcactcaaaaacaggtttcgtagctagaactattttccaataataaagccwaacatcagctatcaatctaataatctccaatcatctcaagtcctccaaacacattaaaatgaatttataacagtaaatgtatcacaagcctcaacacccc

SEQ ID NO: 1134 - DNA, 201 bp, Homo sapiens
tcacgcaccaggttctcagcttccaatatttagttgacgttgtttgcctgctgtcatctctcatctcgttctctttaccctcatggatttctgcttttatrtgtgttcactatcatttaagtggggaaggaaatacatgtcttctctgataatactggagatttttaaagttttcttttgatcccttatggtatctgtttt

SEQ ID NO: 1135 - DNA, 201 bp, Homo sapiens
tccatctgcttatttgaaagaggtatagcagcttctgtctcctgttgtaacctctcccagtctctgatttctttcttccatttaggcagggattaggaaayaagaagagatgtacaggtgtagccaatctgtcacttttggtcagaagccctgagagagctcttttgaaatcagctatctcaggatactgacttaaggact

SEQ ID NO: 1136 - DNA, 201 bp, Homo sapiens
acctattaaccacatcaaatgacttcttactataaagattgagaaattaagataccctctgccctttcttcccaatttttgttactttcattttcattttyagcttttctactggtttgtattccacattaaaaaaatacacttaagcctctatttcttgacccaggaattttagatggaaatgtcttagctcctaactgt

SEQ ID NO: 1137 - DNA, 201 bp, Homo sapiens
cttacctaatttagataccttatttactagtccattctgggacaatcagggtacaacccactatctttgtcaggaataaccattcagtcaaatctaccaaytcctaccctgtcagttctgttttgctacacaaaaatttgacagatatacaacatggttctagaattccagtgctgcccttaccgaaactctctcctgaac

SEQ ID NO: 1138 - DNA, 201 bp, Homo sapiens
cagagatgcctcctatgctgatgtgcaaccaagttgtaaggagctgtcctggatccatcaaggaggaaaacgcagacaatactttacttgatgtttgctcygtgatgtttcttttattgccatttctaacaccaacaatactatggtaatgtgttatctcaattaatacttatcattttcaactgtccagaaaagtgtaaa

SEQ ID NO: 1139 - DNA, 201 bp, Homo sapiens
tgtttgtcctccaaagatgttagtaacattaaatatatcttactaacacacacatatatgtgtatgtatgtacatatatatatgtatgtaaaatacgaggyagaaggtactcaacaagtggtaatttattactatactactccacaatatactcaatatttcaagaaataattatctgctgctgataggcaaaccactgaa

SEQ ID NO: 1140 - DNA, 201 bp, Homo sapiens
tgtcaaaatataattaaaagctaagtataatataatcttcatgtgttttatcaatactacatagagttctatgatttttatcataaataggatctcagcckgacttggcctgtctgctctggtctaaaagatgtgaggagaaaaaaagagacttgttaatatcataatattatcttaaaccagtaattcgaataaagagat

SEQ ID NO: 1141 - DNA, 201 bp, Homo sapiens
aaaagatctgaaatctatcttaactgtctaatgatcagggagaactgttaggtaaataattataaaatgctattaaaagtccttaatgatatgggaaaacsttcataatattaagagaaaaaaagcaagatataaaattccaaatgttgtattttaaaaataaaaatatgtgcatagacaaaagattaaggagacataaaa

SEQ ID NO: 1142 - DNA, 201 bp, Homo sapiens
tactcatctgcaaaatgggggtgatagcgctttcctcataaggttgctatgagaattaaatgagattaattcaggtaaaacacctaaaatagtgcttggcrtgtagtaacagctcagtaaggcatgggtgtaattgttattccctgactcctaaatccaggttaggagccccttctgttattccttcttcttcttcttact

SEQ ID NO: 1143 - DNA, 201 bp, Homo sapiens
cataacctctgcatattcaatgctttcatattcaattgtttgtttttaaagaaattagtttattagagacagagagagaacgaatctttcccttgataatytccactaaactttataaatatgcttagaatggaaatgaatgagaagaaacagaggatgaaggagacatcagaaattttcagccctgtgttttacctctgg

SEQ ID NO: 1144 - DNA, 201 bp, Homo sapiens
aaatatcagattgaataattcagatgaatactccactgagaacaatttaaaatgtaagacaaaattaggactctgataagtcaattgccacattaagctgraatcacaaatggctgatcgttaatgtcaatggggaaccaaaaaataaactaaatcttgcacagatctgcaccctagattcatgtcacctgagtggaccag

SEQ ID NO: 1145 - DNA, 201 bp, Homo sapiens
taattcagatgaatactccactgagaacaatttaaaatgtaagacaaaattaggactctgataagtcaattgccacattaagctgaaatcacaaatggctratcgttaatgtcaatggggaaccaaaaaataaactaaatcttgcacagatctgcaccctagattcatgtcacctgagtggaccaggaaactttaggcttt

SEQ ID NO: 1146 - DNA, 201 bp, Homo sapiens
gtactttcaaaagcaaactctggctagcacaggaaaaatcctttgacaagagaaaggctaaatggatacaataatgatgattagatcatacttacacataycttccaagaaatttctatacttcttttttattctgaagcaatagacattatgggattccaagaaactgagccttcataacccaagtaacaatagccattg

SEQ ID NO: 1147 - DNA, 201 bp, Homo sapiens
ctttcttcccaatttttgttactttcattttcatttttagcttttctactggtttgtattccacattaaaaaaatacacttaagcctctatttcttgaccyaggaattttagatggaaatgtcttagctcctaactgtgtaagataaggaaattagtattcttacacagcaagcatttttaatcataaagtttaaccaaag

SEQ ID NO: 1148 - DNA, 201 bp, Homo sapiens
gtggactgggtaaaagccactgtaaaatttgtttaccctgaaaagggaaatggtccttcccctcctttaaatgccaagtggcactcctccatagatgacawagctggtaagctgcatatgcaaaccatgctggattaacttcatggtcatcaggatgtttgttcatccttaatatgccctttaaatcatggtaaatactgt

SEQ ID NO: 1149 - DNA, 201 bp, Homo sapiens
aggcctgtactttaaatcatctctagattatttaaaacacctaatacaatgtagatactatataaatagtcacactgtattgtttaggggaaaataagggraaaaagtctatgcatgttcagtatgaacgtaaccattcttttttttttttctcaagtatttttgacacacagttgatagaaccacagatgcagaacccac

SEQ ID NO: 1150 - DNA, 201 bp, Homo sapiens
gcagaaaattaactacaaggtgagaatatgaaagatgccagtgtggacaaaccatgcaataaaattttattaaaagagaagcagaaatagaggcagtagcrgaatgggaagcaatatgtcaagagggggcttttctttttaggatggaagatactattgcacctttatatgccggtgtgaatgataaagcagagagggaga

SEQ ID NO: 1151 - DNA, 201 bp, Homo sapiens
agagaaaacacaagttcaagaggtacagcttctctgcattctccactgggaagtagagcagtgaataatattactcacacagtgtgaggattccacaaggyggaagatactcccccttttccatactcagaggattttaaatctttccacccaaaacttctgagcccctcccccccaacaagatacaaaatattttttgaa

SEQ ID NO: 1152 - DNA, 201 bp, Homo sapiens
gaaataatttttcaaattaatgctattcttgttacctggaaagtaactttatcttttgaaatcttactatttctccaaacaatctcaatgtccaaagaagmttttcttgatgattctgtctttaatgatacctctttttcctaaattgtaactgcatgtattaattgcaaaactcccttcaaaacttagccataaaacatc

SEQ ID NO: 1153 - DNA, 201 bp, Homo sapiens
ctccatgttggtcaggctggtctcaaactcctggcctcaggtgatccacccacctcagcctcccatagtgctgagattccaagcatgagccaccacatccracaaccttatcatttttataagtgaattactgaaaaccttctaactgcagcaacctcccaagtattttccttgcttccacttttgtcctctctacttcaa

SEQ ID NO: 1154 - DNA, 201 bp, Homo sapiens
ctcctgaccttgtgatccgcccaccttggcctcccaaagtgctgggattacaggcgtgagccaccacgcccagccacagtaagtctttaataaaaatatasgagtatgaatactctccagaaaaataatcctcctccaaagcctgatcttaagaatttattggggaaatactttacagttacactcttccctttacatgtt

SEQ ID NO: 1155 - DNA, 201 bp, Homo sapiens
aaagaaaaaaggagaaaagtcagagcttctcttttttgttttctagttattccattcatattgattggttctgaaatgttacaaaaatttttggtgttctrgaaaataagtaatatggaaaatttttacctaaggtcactgtttcttctcaattatttaaggtgaaagtaataaaccagacatttaagtaaacatgctcac

SEQ ID NO: 1156 - DNA, 201 bp, Homo sapiens
cctctcttctaataatgtgacataggttagcgcttaatgtatatactgtcttgaattattctctgtgtgtttcatatactggtcttattctctgggtagayaatgaaagcctggaagtagattatgtacaatttgcctcatctctatttattttcccagtttccttattatagagcacgctttcactctcaacagggtact

SEQ ID NO: 1157 - DNA, 201 bp, Homo sapiens
tgtttagattaaaatgtttaaaggtttaatttcaaccaacctctttagccatttaaacactaattttattctttctaaaataacatccaatgtgaaaaacraaggcataataatagattccttttttttttttttttttgagacggagtctcgctctgttgcccaggctggagtgcagtggcgcaatctcggctcatgcaa

SEQ ID NO: 1158 - DNA, 201 bp, Homo sapiens
ccattggaatctccctaaaaactcagctgaatcttctgaggcctctttcatccatcgctacttaggtcactcttcaatttctcaggatggttgtttcaaawctttcccaggccttcttccttgcctggtaggtatacttaaatgtacacactaacccttacctagtcaagctactaagctaagactagaacccaggtctgt

SEQ ID NO: 1159 - DNA, 201 bp, Homo sapiens
aaaatttcaggggaggggtctcatcaaatatttgttcaagctatgaaatacctggaaatctgatttttgaagaagtgttagccctacatctgggaaatttrtatcattaatgttaacttcatcacatatataactgtatgttccatatatcgtcaataaagaacactaacagtataaactccagcctagttcttcaaagac

SEQ ID NO: 1160 - DNA, 201 bp, Homo sapiens
tcatcattatctgtacctcagtaagcataataatgctgttttcaaatgtttccagtgactttgaaaggaaagattttcttaaaaccaaggcatcaggaagraaaatgcatggaatcatcagtatcactgaagtcatccaaaatacaataaaataaaaaagtatataagaattttacattgcataaataatctaagttcctg

SEQ ID NO: 1161 - DNA, 201 bp, Homo sapiens
cacacaaaaatgagtaggaaactctatgagctcatggtacacaccatactactgatcattctacccatgtaattataaagtagtatttcatttatgctatmaagggtttaatcaggtcctgtgaaccctctagtccaacaaaaataatgttacgtgtaattacaaataaacagtataatagaaataaacctatatttttta

SEQ ID NO: 1162 - DNA, 201 bp, Homo sapiens
ttaaggatgtatcccctccactgcacactataaccaggtacatccttttaaaaaaattgaatactgatttggaaaccggatgttcaaaaatttcatcacaytgatatttaagactttccataatctgattactaactctctaatctgagcttttttttttcctccagcataaattctccatccatctaggatattgcctat

SEQ ID NO: 1163 - DNA, 201 bp, Homo sapiens
ttggggattttcccactatctttgttttttaatagtctaatgagattagggattttcttcatatttttcctacttgagatttataggacttttgaaactayggtttggtatctttaactattttttaaaaaatttcaatcattatattttcaaatactttttgctctattctctcctctccttctaaggctccagttatat

SEQ ID NO: 1164 - DNA, 201 bp, Homo sapiens
ttgggggcgaggcatacgtgtgcgcatgcacatgtgtctctgtatgtgagtgtgagtgtcgtggccatggttgtgacagtgaaagtagttagctgttaagraagaaaaatgacctttgtctatattgtggatggtcatgtgcagcataataaagtacatatacaaatcatatttaacagtaaattagtggtgtatccaata

SEQ ID NO: 1165 - DNA, 201 bp, Homo sapiens
gcaggctattatctaagttgcagtggctcaattaatgcctttgggtccttacgatatacactcagatatgattttagaagtatctgcaactcagactggascttatggcaaaaagcccatgaatgctgtccagcagtaaccactgggaccatgggccagacaagaaagtatagaacacatcattagagagacgattattgg

SEQ ID NO: 1166 - DNA, 201 bp, Homo sapiens
ggacatgttgatggtcatcaaaagaacttctttcaggatcaggagatgactggaaccagcaagtggatgtcccagcatgcttgtttgaggtggctatctgrgtccccaaaataagtagatatgggagatattggccgggcacagtggctcatgcctgtaatcccagcactttgggaggccaaggcgggtggatcatgaggt

SEQ ID NO: 1167 - DNA, 201 bp, Homo sapiens
aacactactgatgtttatccagccaacaaaaaagtataatagcacaaagactgccttctgaatactccctagaggccaatcagccaggtgtgagaattctkaggttagggaaactctttgaaacagagttcaagaagagctacttagaaataaagaaacaaattcagatcatgatagccataaagcagaacctgcagaagg

SEQ ID NO: 1168 - DNA, 201 bp, Homo sapiens
taagaaagtagaacccttcacatattagtgctaggaatgtaaactggtaacatctggacaataaactgactttataaatgatttatataatcaaaacatartaaaagttcccttaaagagtaaaactgagaaaaagtggctacagcctttaatcgcaccgaaggcccctacagtgacagactatgagaagaggctaacagt

SEQ ID NO: 1169 - DNA, 201 bp, Homo sapiens
actatctttttgaaaaatttaaatcaggagggaagcaattcaaaatttaattaagattggaagttctcaaacccctttacagttctcatactctgttcttytcatataaataaaaagcctattttggtaaaatttcattaaaacccatattgattaaatatgaagtaatatctttaattatcagaaaaatgagggatatat

SEQ ID NO: 1170 - DNA, 201 bp, Homo sapiens
ttataaatatgaatgaatgtataaacatgaataaaaatactgtagctcattgaacaaagcagcaagagccatagagttcttcaattcatagctgtagctamaaaaacagaaattaaaagtgtgtacaattattttttgccatcaactctttcagctatgcatagaaaagattattttcaaatgacaaaaaagcagttagag

SEQ ID NO: 1171 - DNA, 201 bp, Homo sapiens
aagaaacaaaatctgaagtatctaagatcagcaaaaaagaaatctcaggtactaatcctggctctatacctaacttgaaatatggcctcagttttgaaatmtgtcagatgaatggatataagactagagaggccaccaacagtggctcctgcctgtaatcccaacattttgggaggccgaggcatgaggactcctgaaggc

SEQ ID NO: 1172 - DNA, 201 bp, Homo sapiens
ataagtgattcaaactcggtttaaactattagtttcatacacctcataacttgtagtactcataatttctgataaatttttataaactgtactcctacttytcacaaacttcttctcctcataatttaagaattaaattggaatacagcagtatgtgaatcatgaagcttaaataaatttgtgtatctatacattaaaaca

SEQ ID NO: 1173 - DNA, 201 bp, Homo sapiens
ttattgttttatctttttcttaaaaaaaatacagtagccattctaacccactaataagggctaacctgaattaaacaataggagtaaaaaaagatcacggyttttataatggtaaaatgaaatttgtaacattcaaagacttattttcttgaattttttgttatattattgcattttttagcttcaaatttcccttgtatc

SEQ ID NO: 1174 - DNA, 201 bp, Homo sapiens
taggctgtaattcagcagctttggtaacttttctgattcatgaggtaaatttctcatctcaaatatctggtcatttgaagtaatactggagatcaaattaygcaaatatgctgcatgactaaattaaaggcctattcatgtgagcattagttagtaatgggagttgtattatatactgcattattagaaaatggggcagca

SEQ ID NO: 1175 - DNA, 201 bp, Homo sapiens
acaaggggcaggtcctggggaatcccttgtaaaggatgagatgggagggatgggctctgggtgatgtagggagagagatggagacagaggcagagagagargctggagccaggaacacagccaccataggagggtcaggatgaaaggagcaatgataccagagcaaagcaggatgcagacagactgctggcttcttccacc

SEQ ID NO: 1176 - DNA, 201 bp, Homo sapiens
gtgatggggtttgtaaccacttctcacatcgttgagagaaaagggtgagcctgactcagaggtgtggcaaaggaagggcagggcaggctttaaggacaggsacagggctgtcagaggctgaggctagggaggggcaggaaggggtgtgaggcagggcggaagagagcagggccctgggcaggtgctgagccaggtcctgca

SEQ ID NO: 1177 - DNA, 201 bp, Homo sapiens; identical to SEQ ID NO: 1000

SEQ ID NO: 1178 - DNA, 201 bp, Homo sapiens
gaaatggtctatactttgattaggaagtagactacgatttgattaagaagtattatagctccctaccccctacccaggatatgggagtttataatactccyatagtgaaaaatttcaaggaaatttcttttgtattccccaaactgaaggtttctaccaccctttttgtttcccagcagtgagagatggaattctgaattc

SEQ ID NO: 1179 - DNA, 201 bp, Homo sapiens
tttggttggtcgtgcttttagggtgatgactctgtatgagttccttggttatggagagtgtttgtatgatagcttcctcagatactggttgtagaagctaygtacttggtgtgtggataagttcactatctcctatggggttggaatgacagaggtcttttgaagcttatcccatttccgtgtggtgtgcacttatttatt

SEQ ID NO: 1180 - DNA, 201 bp, Homo sapiens
gggaaatgggagtgtgcagcatggaaagtgtcattgttttaggaagtagctgaaaagcttggataagttttttctgaaggaatttgatccaagagccaagraaagtttaaccttagttcagtttccccccattttcttcagctacaatgcaaatagcacgtaattgggaacttgttttatgttatgattattacaagacag

SEQ ID NO: 1181 - DNA, 201 bp, Homo sapiens
tttttatagatgatgaagtacctattggggctaaatatttttaacagacaaaaaaattaactgttcaagatggcgttataagtttcttttgaagagaaggytgttgggccttctgaaaagcatgctaattaacagaaagccataaccattattgcccccatccttttaatttctttcttttttgggtggggaagacagggg

SEQ ID NO: 1182 - DNA, 201 bp, Homo sapiens
aggcggagcttgcagtgagccgagatcgcgccactgcactccagcctgggtgacagagcgagactccgtctcaaaaaaaaaaaaaaagctctaatgaaatraacttattttttcagtaataagcatttttttcagagacaaatgtaagatactgtctctaaatttacaaatacacacaagtacagaggaagacaagctcta

SEQ ID NO: 1183 - DNA, 201 bp, Homo sapiens
tggtgggtcctttcaatctggagatttatatccttcagtaatgggaacttttctggtatgtttctttttcttttctcttttagctttctgttttctctctstttaatctattttttggaaatttccttaattttttttttttttttttttttttttttttttttgagacagagtctcgctccgttgcccaggctggaatgc

SEQ ID NO: 1184 - DNA, 201 bp, Homo sapiens; identical to SEQ ID NO: 1001

SEQ ID NO: 1185 - DNA, 201 bp, Homo sapiens
ctccttcctcttctcctccagaatggctgtcactggttggtacttccaggcaaatttatgaaccaggtgccccaggtaggcaaacttcagtgtgggcttcrggtgcacaaccttgagtagagtagaaatcaccatccacttttgcaaagggcagggcacagggggtgtggatcccatcaaataccttgaggtggtccaggt

SEQ ID NO: 1186 - DNA, 201 bp, Homo sapiens
gttaaatttttttctttctgttgatttcctgttttcagtttcattaatttctgctcttttattattttttttcttctgcctgctttgggtttaatgtgctyttctttgtctagtttcctaaggtagaagcttgcattattattttagatctttcttcttttttagtatataagttcaatgctaaagccttccctctaagta

SEQ ID NO: 1187 - DNA, 201 bp, Homo sapiens
aaggtggtatcctcctgatttctccactgtaaagttaccattttctctttttgaattaataagtattctgtagcgacataccttgagaccatgaaactatyttgcttaccatcaaacttttacccagtagttttaacatccactgatggtttgggcttgaatcagttattaatatgatacttgcatttatttgtgcttgaa

SEQ ID NO: 1188 - DNA, 201 bp, Homo sapiens
ctaatgtaacaatggacagttattacattcagaaaccttaacatggataaaattgtattctctattatgtagaccttaaatcaaattttaacagttgtccyaaagatgccttttatagcaatcatatcccccaaccccattcattatcttgtattgcatgtagttatcatatctgtagttcttcagcctttttgtgtcttt

SEQ ID NO: 1189 - DNA, 201 bp, Homo sapiens
catttactataaaataatttttagtacacaagatatattaagatgtagttttgttgtttttccaagcctattattaaataattaattgaaagaatttattrcattttattgaatgtactatttatttatttgttttttagctttaggatccttttccactgtatttggagaagaatggaaagagaagactgatagagactt

SEQ ID NO: 1190 - DNA, 201 bp, Homo sapiens
aaaatttcaggcaggagaatccatctggacaagggtgttatctgttcatgctttagctgcctggaagtggagagtaggctttttcaagcttttaggatttwtagtttaagccagactctaatgcccatcagttaagcaagttcttctaaaagtaaggtacttgaatgtgggatatcaacaaacaagcaatacagttatcat

SEQ ID NO: 1191 - DNA, 201 bp, Homo sapiens
cagcaagactagcagtttatttttccttcttcacaattttagggatggaatatttgttctttccatagagctgagcaacctcagcgtatgattttttcttrttattaattttcaaaaattattggaaaatatgaagaaaacatcttgcataaatgacctacattggaaccctttgctctatctctttatttcatgcaattt

SEQ ID NO: 1192 - DNA, 201 bp, Homo sapiens; identical to SEQ ID NO: 1002

SEQ ID NO: 1193 - DNA, 201 bp, Homo sapiens
acattgtttataaagacttctcatgatttcaacgtaatttctagtgtttcatgaaattgattgctaattcattcaggaaatttcagtctaagtagggtatrctctttcatagtagagatgataaagggaggaagatttctacacagtttcaggccctagaaagtattttctgtattaatatcgtcaacttagaaggggaag

SEQ ID NO: 1194 - DNA, 201 bp, Homo sapiens
gaaggccaaagcaggaagatggcttgaacctaggagttcaagatgaggctggcaatatagcaagaccttgttcctacaaaaaaaataaaaaataggtggtsatggtggcccttgcctgtggtcccagttactcaggaggctttggtggaaggatcgcttgagcccaggaggcggagtttgcagtgagcggagatgtaccac

SEQ ID NO: 1195 - DNA, 201 bp, Homo sapiens
taaaagattttgtttgaggcattggagaagccaaagcctgctcctaggttgaacttccagctcatggcctagttgtagtcctgctgcaggttctgctgcargctatttgctgccttcttgctgagggtcatgttgggccttgcagtcatgctaggggggcagctgaatgaaggggtcagatttttgaatccacccatgttt

SEQ ID NO: 1196 - DNA, 201 bp, Homo sapiens; identical to SEQ ID NO: 1003

SEQ ID NO: 1197 - DNA, 201 bp, Homo sapiens; identical to SEQ ID NO: 1004

SEQ ID NO: 1198 - DNA, 201 bp, Homo sapiens; identical to SEQ ID NO: 1005

SEQ ID NO: 1199 - DNA, 201 bp, Homo sapiens; identical to SEQ ID NO: 1006

SEQ ID NO: 1200 - DNA, 201 bp, Homo sapiens; identical to SEQ ID NO: 1007

SEQ ID NO: 1201 - DNA, 201 bp, Homo sapiens
ttcagctgtgcctaatatgctgcttgacttatttgttaaatttctattttagtgatcatgttttaatttctagaaattctctccatcctattttagatttkcccttttgatcttcttttttatgtttttaataattttgaagatttttaaaaatcttttaataaattaatttgaattatataaatatatagaaacaaaata

SEQ ID NO: 1202 - DNA, 201 bp, Homo sapiens
aatggcttcccttggtctgcactggagattgggaatgcctgcaaggcacttcccactgctgcttctacttttatatttcactgctccctaaatcagttccwgttctgtgttggattaaggccttcacctgtggcctggatttttaagttccttaatggggatatgtatcctggaggcagtctctcccactctaacactctg

SEQ ID NO: 1203 - DNA, 201 bp, Homo sapiens; identical to SEQ ID NO: 1008

SEQ ID NO: 1204 - DNA, 201 bp, Homo sapiens
ttattcattaatttaatgaataataattgatcacgtatcttgtgctagactctatgcactggacatatatcaatgatgagaacagagaaaaattatttccyctttagagtgagggaaaggagacaaataagagtatgctagctaatagcacaaggagaaaaataaagcaaataaagggagatggcttttgcttgagtaggg

SEQ ID NO: 1205 - DNA, 201 bp, Homo sapiens; identical to SEQ ID NO: 1009

SEQ ID NO: 1206 - DNA, 201 bp, Homo sapiens; identical to SEQ ID NO: 1010

SEQ ID NO: 1207 - DNA, 201 bp, Homo sapiens
caagtagcttaataaccttctgaatctttatttggtatttcaaagatttcatcttggtttggatccattgctggggagctagtgtgatctgttatagaacyctggttttttttgtgtgtgtgtcaccaaaattaacttttctggttccttctcattagggtagactatttctgttaagtattcttgaatttaagatttctt

SEQ ID NO: 1208 - DNA, 201 bp, Homo sapiens
ctattttttaaataagatattttatataaaaaaggaaactttaaaaatggaaattaggatgataatatataagaagaggtagtatgctgaaaactgcaatyatttaaagaaaagaagtctaaaaatatattctaaaagttcatagtatagtatatattgtatagagatgttcttttaaatagtggtagaaaagaattccag

SEQ ID NO: 1209 - DNA, 201 bp, Homo sapiens; identical to SEQ ID NO: 1011

SEQ ID NO: 1210 - DNA, 201 bp, Homo sapiens
aagatttattatgcaaattataaccataagaaagctggagtggctatattaatatcaggcaaaatagattttaaaacaaaaaaaagttactgaagctaaaragggacattttatattcataaaaaaattgcagttcattaagaagacataataattgtaaattgtgaatatctgcatctaacaacaaagctccaaaatagt

SEQ ID NO: 1211 - DNA, 201 bp, Homo sapiens
aaaaaaaagagatacttgtttttcaagctatgttctttataaaaattataattattctaaatatttattatcattattattatttactggtactagttctrtactcttacaggttatccttagatttatactgtctcatttgtggactatcatcagtatcatcaacttttttttcgtattatctattttcaaagtttctta

SEQ ID NO: 1212 - DNA, 201 bp, Homo sapiens; identical to SEQ ID NO: 690

SEQ ID NO: 1213 - DNA, 201 bp, Homo sapiens
gaaaacccctgagcaccacggacagatgtccccaacaccgccagacgtccccaacaccgccagcgcccaccctggctcaccgtgcggatctgcctccgcaraaggtaaatgaagaagctccagagcttggcggcgaaggccacgaacgtgcgcagccccagcagacactgcgtccgcatcatcccgatgaccccggcaccg

SEQ ID NO: 1214 - DNA, 201 bp, Homo sapiens
ttcccgggcagtgcaccatttctttatttccaaggataattcagtgtaaatcaccttaattaaaagtgtcagcccagcccatgaatattgtacttaggaaygcgtttcctgggtcccagttataatttaaaacccatggatcactaggcagcgagtgactgagcaagggaggaaatcgttgggggcgggctgtggaaatag

SEQ ID NO: 1215 - DNA, 201 bp, Homo sapiens
tttgagactctggagcccccagcagctccagaaaactttatccaaataagtgtggacaaaaatgtttcagagataattgctacaattatggaaaccctaamaatgaaatgacaatgattttgtatcagtggtccaaacagaactaagcataaatcattgtgccatcccaaacctcgttccagccgccttgcccatactaga

SEQ ID NO: 1216 - DNA, 201 bp, Homo sapiens
catcttgagccgcttggtcgacagccagagtgccccggggtcggcaacagcgtctgggtcagggctgcggcgctttcttcctggcccagctatcttggcarctctttgtggccaaattctccagcaaggaacggacagcctaatggaaagaagccagtgatcactgccaagacccaacaacttgctctttagctacaccca

SEQ ID NO: 1217 - DNA, 201 bp, Homo sapiens
tccatcagcaacagtaaagggcaggaacatagagatttctttttccaggcccaggcctgtgaaaaacgatggctaagtgttagtccttagcagggccgacrgatggtctccattcctggttaaccctctggaatttgggagcatgagtatctccaagaattcatttctactcagtaaagatggggaggggaatcccactgt

SEQ ID NO: 1218 - DNA, 201 bp, Homo sapiens
cctctctggcatgggccccagcatgagacacatggagaagacctgtgcttcacccacgggcagaagcagatatcaaaggctgttaattcaggaggtaaagsagacactcattactcactgggtttcagacatcaagaacagcccaacaggtacacttttctacctattgttctggcctccaagtataggaaattatgtata

SEQ ID NO: 1219 - DNA, 201 bp, Homo sapiens
agctcctttgcatctcctttggtccacaccaggagactcccagcagatccgtagccctcgatcagccacatggggtttaccacccctgctggagaaaatcrcctgtcatcagactgcggtccccttcatggtccccagctgtgggaggccctcggagccacaccacagccttatttttctttctctctgtcccctcacacg

SEQ ID NO: 1220 - DNA, 201 bp, Homo sapiens
ttgctcttcatcatcaggcacaggtttaatgagggtgtccaccctgcctttgccctggagaaacctggaaaatgtactttgcacctggggatagagccccyggattctgtaaggcacaagtgatccttggctttcagaatttgcaagaacagcgatttgaattttgggggggtctgctgttcattcctttaggtgctatac

SEQ ID NO: 1221 - DNA, 201 bp, Homo sapiens
ttttagttttgaaagacccaagtgtcattctcagtagacattttgaaagacccaaatgtcattctcagtaggtacatctcagtaacatctgttgaagggtrtaacaacgaagcttgatccaccagtggactgaaatgatactgggcttactaagactgaagagttcctataaccagtaattaaaaatgggccagcctccta

SEQ ID NO: 1222 - DNA, 201 bp, Homo sapiens
agcatcccttgggcatcccgggaggtgtccctgccctccatggctcaccgtctgccacatggcccagcagcagctactctgcagggccatgtgctgccatsacaggtactgatccccatgggcgcgggcctgcaggtcctggaggtaccagtggtcaggtgctttgtacatgcagctcatatagagcaagctagccacact

SEQ ID NO: 1223 - DNA, 201 bp, Homo sapiens
gtgagggaggctgtctactccagtgttggagtcagctggaggtgcagcagcgcttgagctatccaaactgctaggatgttgttaataaaagaaccttctcrttctcgagtcaacatggctaaaacagccagccatgagatgtatgggaaagaagtgcagagcaagttgttatttattgaatgtgtagttaggaattactat

SEQ ID NO: 1224 - DNA, 201 bp, Homo sapiens
ccaggccatctcaccgcttctgggaagagaacccaggcaagtgtggagaggaggagaggagaggtcccaggcaagcaggacaatgaggagccatgatgccyggcctgtgcttctcccagttctctctctgccttcctcaccctggagttaccagaggctgatacacgttgaccacaccagtgctcccttgccctccaacct

SEQ ID NO: 1225 - DNA, 201 bp, Homo sapiens
tgtctgtcacctcagtttgtcgttctgttaaactgcagtactgagatatttggggctgctttccacgctgcccgcagaggggtccatgcaggctttccatrgtaacttaaagggaaaccttcacagtgtcacaatgcctggagacctggacgtcctgcctatgaaggacgaggatgtgctcaagttccttgcggtaggagc

SEQ ID NO: 1226 - DNA, 201 bp, Homo sapiens
gaagactggcatggacacagtccccttgtacatctgaacccacaggtaccagtcatcgaagcgggtgtagttccggatggctttgttatactctgcagtgrgggagatgggataatggacatatgagtgattagggagaaaaaaggcaggcctggacagcggaagcgagaacttacactttggaaagagcaccaggatgca

SEQ ID NO: 1227 - DNA, 201 bp, Homo sapiens
acagggcggaaagtgggaatcactagctgatttctccctgggacctagcggctgtgtcggagcaagtcggggtctgggatggacggaaagggaaaggaccsggttcacgcttcccattccccaactgcgaaagggcgggtcacagttcacctgtagtgggcgggatctggcgcggagccgtcgggacctggcgcaccatgg

SEQ ID NO: 1228 - DNA, 201 bp, Homo sapiens
catggggataattaactcctagtaagaaaaccacccagagccactgaaaggaacagatggaaagaaatgaacttgtgggcagttgtggaggatggagcctwgtagaggggatttggggtttcagcaaccagagcctgtgggcagatgacaagccagaaatgctgctcacctggccgaagtgggtagccctctcgcttctcc

SEQ ID NO: 1229 - DNA, 201 bp, Homo sapiens
aactccatctcaaaaagaaaaaagcagaaaataattgatgtggtttggctgtgtccccacctaaatctcaccttgaattgtagctcccatatttctcacgygttgtggaagggacctggtgggagataattgaatcatgggggccgtttcccccatactgttctcatggtagtgaataagtctcacaagatctgatggttt

SEQ ID NO: 1230 - DNA, 201 bp, Homo sapiens
gggctgagctcagcgatccagcccacccggctaatccaggactttttttttcactgcgagaggctaagtggatcctggaggtgatagtaagaattgcgggragcgcggctctagctcagctgggagctttctggtgccggtgaggagaccatgaagccaccagccccagctgacccgcccgccgaggcccagagagtcaga

SEQ ID NO: 1231 - DNA, 201 bp, Homo sapiens
tctccattccccttattcccaagtttctaaaatttggtcagcaccttagaccacagcaacacccatgactttggtcagtgtgacatgcggtagaaccaacmctggatttgaagtcagatctaggatccagttaattacaactctgtcactcatctataacctgtgtatgtgaccctctccttctctggggctagcatcctt

SEQ ID NO: 1232 - DNA, 201 bp, Homo sapiens
gccctcactaattccacttaagacctccagtttctgtcctaggattggtgacagcagaagaaaacactgagagctagaaatcatctagagacttcataccragagactggttaagtaaattcctaggtcccaattaagagtcacgatgttgtcatttaaatggacacaatataaagaacgcaaactacgcatagaagtctt

SEQ ID NO: 1233 - DNA, 201 bp, Homo sapiens
ggctgaccagtgacttccaccacaagggagagaaaggtggccaggttctggcatagagaaggtggcggaggttgttgcctaattcccaatatctgttcccygcttcctccttagtagcaggattcctaactttagctaagcacaggctgcctggctgccaacactaactattctaacagctaggtgggattaaggacacca

SEQ ID NO: 1234 - DNA, 201 bp, Homo sapiens
tgggatcccccgtggcacggtagaggtacattgcgctttcaataagttctgcaaagtccaaagcagaccctcctcactcagtggctgcacagagatggccwggggcctcttagggccgtgagggactactcccctccatatcttgtccataaggccccaactagcaggaacacaggatacctcacccagtgctgagtttca

SEQ ID NO: 1235 - DNA, 201 bp, Homo sapiens
ttattgctttactttcctgtgcatctgaccaactctgtcgagcagtggtccccaaccgttttggcaccagggaccagtttcatggaagacaatttttccakgaactgggcttgtaggagatggttttgggataattcatgtgcattacatttattgtgcactttatttatattattattacattgtaatatataatgaaat

SEQ ID NO: 1236 - DNA, 201 bp, Homo sapiens
accccatctaaacaaaaaatttaaaaattagccaggtgtggtggtgtgggcctgtagtcccagctattcgggaggctgaggcgggagaatcacttgtgccygtgaggctgcagtgaactgtgatcaccccactgggtgacagggtgagacgctgtctcaaaatacataaatacacaaataaaaataaaaacaaaagtaaaa

SEQ ID NO: 1237 - DNA, 201 bp, Homo sapiens
gcaaggccactgctgtaacccttgggcctagcagagtgcctggcatgtgaaagacattcaagaaatatctgtgagactaagcaggactgctttgttaaggmgtcccaggtttgaatatagggctatgggactctggattccccttaaaatctattttagtgtctcacaaaacttttcgctaaactcaccttttcaaagtca

SEQ ID NO: 1238 - DNA, 201 bp, Homo sapiens
cacagggaagcagctgaccctgacatcttcattggatgtctcatggacagaacaaacttggcacttcctaaacaaaattcttggttcccttactttcccaygaaattgcctccctactttggcctttttcccttcttggtaaatgacacaatgtctacctggttattctggatagaaacccggtggccacttttttttttt

SEQ ID NO: 1239 - DNA, 201 bp, Homo sapiens
ctactttttcttaaaacttttaaaaacgtagattataaaaacattttggtacatgcactattttggaacaccaaagtggggtagattagataagctctaaratccttccagctgcaactctaccagaccatgtaatggaaaaacaacgagatggcacagcggcacaagctgcttcctgcccttcctgaggcccactgtcaa

SEQ ID NO: 1240 - DNA, 201 bp, Homo sapiens
taaaaacattttggtacatgcactattttggaacaccaaagtggggtagattagataagctctaagatccttccagctgcaactctaccagaccatgtaayggaaaaacaacgagatggcacagcggcacaagctgcttcctgcccttcctgaggcccactgtcaagaatgagattggacagaaacgcccagtggagaaac

SEQ ID NO: 1241 - DNA, 201 bp, Homo sapiens
catcacgtctgtggacgacgccatccggaagctggtgcagctgagctccaaggagaagatctggacccaggagatgctgctgcaggtgaacgaccagtcgytgcggctgctggacatcgagtcacaggtggggcccagcgccacgggggacagggagcacagtgggtagaggcggtggcagccaccggctgcagcccggat

SEQ ID NO: 1242 - DNA, 201 bp, Homo sapiens
tcagaatgctttctagttttcttgtgacttcatctttgatgcatgggttatttagaaatatgttgctttgtttctaaacatttggggattttctggttttmtttttattatgggtttctaccttaattctgttatgatcaaaaaacatattctgtactgttgcagtcacttgagatttactgagacttgttctgtggccca

SEQ ID NO: 1243 - DNA, 201 bp, Homo sapiens
acactgaaggttggtttatgagcagcaggcatacaaaggaggaagctggagtggaaggagccgtaaaattgacaaagtggtctctaatataaccctccccmgacacacatacaaatacaacactttcttcctaactttcacttagcttagctgtagacagttccagcaaaccttgtttagcactgctccgtgctacattga

SEQ ID NO: 1244 - DNA, 201 bp, Homo sapiens; identical to SEQ ID NO: 1050

SEQ ID NO: 1245 - DNA, 201 bp, Homo sapiens; identical to SEQ ID NO: 1051

SEQ ID NO: 1246 - DNA, 201 bp, Homo sapiens; identical to SEQ ID NO: 1063

SEQ ID NO: 1247 - DNA, 201 bp, Homo sapiens; identical to SEQ ID NO: 1067

SEQ ID NO: 1248 - DNA, 201 bp, Homo sapiens; identical to SEQ ID NO: 962

SEQ ID NO: 1249 - DNA, 201 bp, Homo sapiens
ttgtttataaagggaacacattagaagctaagtaattgggtcagatttggtaattaaaagcagctgaataatcaacaaacgcttaacaaaggtgttagaayaagatcatattttaacagaagatgaaatacatagaaaggtttgtatatttcaacccttattcttctgcctgttttgcatttttcttttaaaaatacacaa

SEQ ID NO: 1250 - DNA, 201 bp, Homo sapiens
ctgatgttggctctggagaatgagacagaaggggaagtaggcaccatggggagaagacaggtgcccctccagaggcagggccctttggtgagggaggagarttgttgcaggcataaactgacctgcatctccagaagaacccccgacctcagactcaagaaacaatgctggacacaccccagctctccctcccaagaatct

SEQ ID NO: 1251 - DNA, 201 bp, Homo sapiens; identical to SEQ ID NO: 1041

SEQ ID NO: 1252 - DNA, 201 bp, Homo sapiens; identical to SEQ ID NO: 1043

SEQ ID NO: 1253 - DNA, 201 bp, Homo sapiens; identical to SEQ ID NO: 1044

SEQ ID NO: 1254 - DNA, 201 bp, Homo sapiens; identical to SEQ ID NO: 1045

SEQ ID NO: 1255 - DNA, 201 bp, Homo sapiens; identical to SEQ ID NO: 1046

SEQ ID NO: 1256 - DNA, 201 bp, Homo sapiens; identical to SEQ ID NO: 1047

SEQ ID NO: 1257 - DNA, 201 bp, Homo sapiens; identical to SEQ ID NO: 1048

SEQ ID NO: 1258 - DNA, 201 bp, Homo sapiens; identical to SEQ ID NO: 1049

SEQ ID NO: 1259 - DNA, 201 bp, Homo sapiens
gctgggattagaggtgtgagccactgcacccggcctattattattattgaaagtaccacataatgatccacacagatttttaaaaacatttttcagatccrtgatctcatttaattctcactaacacccctttaggtattattattactcctattttacaaatgaggaaactgaagctcagagaagaactaacttgccaag

SEQ ID NO: 1260 - DNA, 201 bp, Homo sapiens
caggggctgagcctgtattagaacccaggcttgtttcccagcccagccaagtcccagaaaaatccccctgattttatctatttttttttaacctgggatascagcagggaaagcattagaggcaaaaggaaaggattttcatttttccaggaatgctgaagtcaggactgtttgaggggagccctgtgtttctcagactct

SEQ ID NO: 1261 - DNA, 201 bp, Homo sapiens
ccatgactgaccccccaacccaagaagtaaagactctcctgatttggtgtttattattcctatgcaatgtttattgagatataattcatgcaccataaaaytccccctttaaagtgtgcaattcagtggttcttggtatatttacaagattgtacaaccattaccactgtctcattccagaatattttcatcaccacagaa

SEQ ID NO: 1262 - DNA, 201 bp, Homo sapiens
attgttttcaaatattttcaagctgcagttggttgaatacacagatgtggaacccatggatatggaggtcccactgtacttgtctgattgtggccatcctrgttggtcattgtggttttgatttgcattttcctaatgacaaataatgcgcatatcttttcatgtgcttattggtagtttgtatatcttctttggagaagg

SEQ ID NO: 1263 - DNA, 201 bp, Homo sapiens; identical to SEQ ID NO: 1060

SEQ ID NO: 1264 - DNA, 201 bp, Homo sapiens; identical to SEQ ID NO: 1061

SEQ ID NO: 1265 - DNA, 201 bp, Homo sapiens
atggacctggaagacccctctgcccatgacctcatatatacagcaacatgactctgagaatcagctgagcactaaaaagcatcctcccatcacattcctgkaagatccacttcaggttggaatatgctgggctgccctaaccttggcccctggtgtatatgcctggaggagacctgagagcctctgtccccaccccaacct

SEQ ID NO: 1266 - DNA, 201 bp, Homo sapiens; identical to SEQ ID NO: 1068

SEQ ID NO: 1267 - DNA, 201 bp, Homo sapiens
ttctgttgtttgcatagatttttccaagactcgtagctctacttaagtgcaactgttctttctaaaggcacagcaaacccagtacctcttggtctctctcsatgccctgactgtcttgtaacctttttggctttgtctttctcatcttcctgtgagccttctgtacaatcagaaacacaacatgctccttcttccctgtcc

SEQ ID NO: 1268 - DNA, 201 bp, Homo sapiens
aacgccaaacgctccgccccaaggaatcctacctcaccttctcataacctgcccattcattctccttcataatcctccaaatcctcattttccacccccamatgtccgttttcaattgatatctctttgttctcctcgcaatcaccaactcccatctccaaccagcactcaggactcacttggagacaccccttcctcacg

SEQ ID NO: 1269 - DNA, 201 bp, Homo sapiens
cttacctcaaaaaaaaccttcccaggtgttttcaaaggaattattttattcctccacaacaagcctgtgggagtcggagcaaaaggcaaagtgattacctragacattagataactcgccaatattcaccctgctaacaactgaggggccttgggcttgatctcctgcttccgaatcagggcttttcctgccatcttgtca

SEQ ID NO: 1270 - DNA, 201 bp, Homo sapiens
cacttgcatgccctagcacagatgcccaccctaggcctggcccctttcttgctttcccaatccacgggaccagtgacacttccatgcctgatacagaagasaaagttgcataggactggtgaaaagacgtgggcaggggatggtcctctgcagtcgcctggcctccatgtctcatcccacctgacacagagaggcagccac

SEQ ID NO: 1271 - DNA, 201 bp, Homo sapiens
aggaattgaacccaagtctggagtaattttagagcttgaacattctcttttcaattatgctgttttatagtcaggatccaattatgtccattaagagatgyaataatgtcaataactcaaaagggaggattcaaaacatgtttattattttatttagcaatccaaaagagctatattacatttatttattgagcatctgta

SEQ ID NO: 1272 - DNA, 201 bp, Homo sapiens
gacaaccagcgacatagcaagaccctgcatgtgtgcatatatgtctgtaagacagaaaatgagacagagagactctagagagcacgcagctcagctaaagraaagacctgctacccaccactctgtaaccaacctgcccccaccccattccctggtctctaaggactaagataaccccaactcagatacaatgacccattc

SEQ ID NO: 1273 - DNA, 201 bp, Homo sapiens
ttatttatattttttatatatatatagcatatggcatatggaggtatctgttggtatatacacatacttcctgaggtccattgatactgcattaaaccatrgtatttggatactgttaagctcacacacatttacagggcaagtccagggcctgactagtttggtaaagatacaacaagccactgttactttaggcagttt

SEQ ID NO: 1274 - DNA, 201 bp, Homo sapiens
cagccatgtccactcctggcacacttggctctcctcccaaacctactgccaccttgaccgccagggccatagcttggttttgcccctctctgaattttacrtaaatagaatcatgccatgtgccctcctgtgtgtctggcttctttccctcaacattacgttgctgcaatgactccgtgacaggcagagctgtgacttgtc

SEQ ID NO: 1275 - DNA, 201 bp, Homo sapiens
ccctccctcctggagcccccttgctgtgggcatggtcctcaccagcccctgagtgcctgtgctctgggcacccggggtcccctccttcctcagaagctcaygattcggtgtgactttgttgatcattttctggtaatgctcaacatatttgagcatatttccagaaacaaattttcctgctcactttgcagctctctctaa

SEQ ID NO: 1276 - DNA, 201 bp, Homo sapiens
tgaactaacgaagtttattaaccaggcaacccagaatcattaatcacgcagaaaaataacacagcgaaatgacttttcaaaatgccattggtataattatygtcttgcccattacactaaatgccgccatttatatctgtgatacttaagtatgcaaacagtaattaacgtggtaatgaaccgggggccccagagcctccc

SEQ ID NO: 1277 - DNA, 201 bp, Homo sapiens
tcactcactggcctgagggccacagggccctggtgctggtgggaaggggggcggtgaggaccctgccaggcagcctcatggtgccctggcctcactgggcmacggagacaggaggagctcggtggggacgcacggtggaaggtctggggctgtggaggagctggggctgccggcctcgcaggtgtggttggggtgggtggg

SEQ ID NO: 1278 - DNA, 201 bp, Homo sapiens
cttatatgtgaatttttttcaataaatacagccagcctttcatattggtgggttccgaatccacagccaaatgcagatcagttcttgggatgtgcaaccckcgtacacagagggccaacttttcatatctaggggttgggggttccacagggctgactgtaggacttcagtatgtggggatttcagtatctgagggttgtc

SEQ ID NO: 1279 - DNA, 201 bp, Homo sapiens
cttggcatctgagtttgcctgacacagccagggaggtgaggtggtggcccgttggtggtgtgcgattgagtttgggtcgaaatccaagggtgggaaggacygtagggattgagagatgcctgagtgtagaaaccattgactaccaggtaacagatttgattaattttgtgcctggaggttttttttttcccccttcccttt

SEQ ID NO: 1280 - DNA, 201 bp, Homo sapiens
gtcatctggaaaaacatcaagtggcccccactgagaatggtctcaatgcccccagtccctttaaatctcaccttaaggtttcaagcgtcgagcaggggtartttccaagtcattgtccaaacaagagtggctcagtggtggtcccacacctggctgggcagctccccctcccacacagcggccactcggccccccagttct

SEQ ID NO: 1281 - DNA, 201 bp, Homo sapiens
acggggcagatgtgaattagtgtctggccctgggtgacttgggagtgcttcaaaaccatttgtcccattgtctcccgaaactggtgatagaagcaaggacrtttcattggcttgacctcttttggggaggaccactgtgccgccaggagggcccagagcaggagggcccggaatgcagcgaacacagggattgattcacag

SEQ ID NO: 1282 - DNA, 201 bp, Homo sapiens
aggaggggacaggatcctgtggtaccccttggaggaggttccggcacctgtaggcagtttccaaggatcccttgtggccacatccagctgttaaatgggcrtgtccctggcagccacagatgtctgtccagtgcaggaaagtctgtccagtgcaggaaagggcaggcagagagctggctcccagccccaaatgcatgtctc

SEQ ID NO: 1283 - DNA, 201 bp, Homo sapiens
gaagaaaaagtgctggagcaatttggttcagatatattcactaatgtgaaatttaagattaattatgatttctgcagaaatcccattatgcaaataataaytgttttcttctgaagggctgcacagcggctgtgaggcctgcgggggccgagatccatctccctgacccccggggcattatctgctaggaaactttgtcaa

SEQ ID NO: 1284 - DNA, 201 bp, Homo sapiens
atcatggcaggacataaccatgtggggagggagtggcgggggcagctttcaccctggctctgcaggggccatgccgtcctcctaccttggggttcgctgcyggtgggatgggcctcgagggcccggctgcatgctgccaggcagtcctcaaacctgccgctgtggagcagagcttcaggtgacagggtgtcactccgggtg

SEQ ID NO: 1285 - DNA, 201 bp, Homo sapiens
ctctgcctccagtggggaaggaaacagggtccatgttttggctgaagccccttcagctaaagacccccccggaaagagggagagccctattcccctccacygtgcaccccggcactgtgctgtagccatgcatgctgcccttttgcaggattgccagagaatcgtttgccgagactggggtgcttttgagagtgggggaag

SEQ ID NO: 1286 - DNA, 201 bp, Homo sapiens
ttacttcatcagtctgatggtttatctgtagcgtccttaagatattttacatataaaatcatgttgtccacctataataaaagttttatttcttcctttcyaatcaaatgcctcttatttccttttcttggtgtgatcacactggtgaggacctcagcatgtgtgacttaaactacacaggggagctgccatctttgtctc

SEQ ID NO: 1287 - DNA, 201 bp, Homo sapiens
agcctgggtgacagagagagactccatctcaaaaaaacaaaacaaaacaaaacaaaacaaaacaaaacacaggatcttaatgtctcagttgtggagaccakaagcccccagtcaaggtatgggcagggctgcactccctccagtgcctctgggggaaccctcccttgcatcttccagctgctgtggcttcaggaattcctt

SEQ ID NO: 1288 - DNA, 201 bp, Homo sapiens
ttatggggtctaagggcggtcccagccccaccagctgaggccctgctcagccctctacttcccctgcaccagacacccccttctgggcctccctccagagygtccctgcctgaggcagcccccggatcactgccctgtgggaggatgagctcttgataggggccggccaggacatggggcctggggctccaggcctcagtt

SEQ ID NO: 1289 - DNA, 201 bp, Homo sapiens
gagggtggcccttgtccattgcaggcatgcaggggtgagaacggtccgaggggctcacaagggtgaactgggggccacggatgtacgctccaggctggggrctcaggcaaggccccagggggccccacagagctccctgcataaaatcaggggccagtgaagggggtcggcctctgtcccagccatatacccagaggtgca

SEQ ID NO: 1290 - DNA, 201 bp, Homo sapiens
tcaggcaaggccccagggggccccacagagctccctgcataaaatcaggggccagtgaagggggtcggcctctgtcccagccatatacccagaggtgcagkatgcagagtctgtagccccctctctggggtcttggtgcccctgcctcacctacacttcctctcctggtggccccagacccctggggtgggagctgacccg

SEQ ID NO: 1291 - DNA, 201 bp, Homo sapiens
gagcaccagacggggtcgcgacactcaccccgtggccaccgccagcagcgtggagagctcaccaagggtgtgatggatgggggcgcccatcctgcaaagcygtgacaaatgtgcctcccgctcacagactctctttggaatccgctaatactccttgaaggtgaagtcccatttttcccctgcaatcacagtattaaactt

SEQ ID NO: 1292 - DNA, 201 bp, Homo sapiens
agaatcatgccatgtgccctcctgtgtgtctggcttctttccctcaacattacgttgctgcaatgactccgtgacaggcagagctgtgacttgtcaccttygatacatagcatcccgtgttgtgacgatgctgcagtctatttgcctgtcctattgtcagtgggtcatgccgacctcggcaatattgctaaccatgctgcc

SEQ ID NO: 1293 - DNA, 201 bp, Homo sapiens
tggagggatttttcagtcctagaatttctatgtattattttttcacagatttcaattgtctggtgaaattctctactttcttaagtgcacttttgttaagmctgtctctgtaactccaatagcgggatcacctgtgggtctgcttctatcgtctgctttgctgttcctctcttggcttacctggtgtattagtttcccatg

SEQ ID NO: 1294 - DNA, 201 bp, Homo sapiens
tcaaggccatattttaaaagttcatgtcgattctgcaacagagcatggagaaaccccttgagaacctcctaaaaccaaagaggggcttaggagttctttgscccctatctcccgagcccgatggctcacactgtgggaatgacacggggtcctgggggcctcagttcaaatcgcggctccacctcggactaaccggatggc

SEQ ID NO: 1295 - DNA, 201 bp, Homo sapiens
tttgttggtaaagtcacggacgtgctgaacagtcgttagtggggttcactggaaatggggccgatcatttctcttcacgccgtgcttcctaccaagggacrcctccttgcctggggtccagggctgagctcagtgctgggcccctggtggtcactgcaaccctcaccctgtgctcaggtggagcctctgcttttcagggac

SEQ ID NO: 1296 - DNA, 201 bp, Homo sapiens
gttcagttacattcctctgaagagagctgagttttgttttagtagcagtgaaattggctgggtttaaactccaaattctattgctttttggtggacagagmtgaagtctccatttagcttttgcagcttccagtgcctgttctttcagcccagctagtctttacctctgtatgtgcagttctgtaggctggagatttaagt

SEQ ID NO: 1297 - DNA, 201 bp, Homo sapiens
aggaaagcacagacttatggaaacaaaagtacattccccagagtgagagtgggctcgagccaatagctcaagagcactgcttaagaatgttctggggtttmaacagcctctagaggtttctcattggttacttggttacaatctatgtaaatggagtggcccacgaccagtctgagtgattgggaccaatcagaggctgaa

SEQ ID NO: 1298 - DNA, 201 bp, Homo sapiens
ccctctcctactgcagggcagagtgacccctgtcctgtgaggatgtggccttgaatggcccaatgggccaggaattcctcggggacaagagctgcattctycctgcctccccagcacccagcccagtgggccctgcagggcacaatgacctggtttgttggttccaggcaggcagggtggcagtgggccccaggggtcaca

SEQ ID NO: 1299 - DNA, 201 bp, Homo sapiens
gcatccaagggaggctgatcagggtttcagagattctgctcactgggggctgaacgaaccgtcaggctctgagctgcaaacttgcagaagggcactcaggycgtgatcaatttgttagcgatagccgccataaatacttgattccccatctggctggacagctccgagggcgctgacgttaactaattgcccgtggtggga

SEQ ID NO: 1300 - DNA, 201 bp, Homo sapiens
ggaggtgaccaatcagaggtactttccgtttttcatctgcaacgcagtggaggtggtggggacattgctaagggagtcgcctctgatcattttgttacttkggtgggaagaggtgaggttttccttttgattcagttctaggaagtcagggcgaatcagccttagactccagaccctattctcctgcctcagtatcatttt

SEQ ID NO: 1301 - DNA, 201 bp, Homo sapiens
aaagtttgaagactaccagatatcaaaacttactgtaaagctacaataattacaaccagatggtactgccaaagggtagaaaaatagaaccatcagacaayagaaaattcagaaacagacctacatctataggaaaatttgatttgtcacaaaggataagctgaacactagtagggataggataatcatttcaatagggag

SEQ ID NO: 1302 - DNA, 201 bp, Homo sapiens
agagaaacagggaagactgctctgttggaaaacagaaacatgttgcagttctcctaagagaaacagaaacagaagatggtgactgggtccctgacagcttyctgctttccctgatggctttctgatctagtcccatattaaaatctagtggcatttctgactttgaattccataagacacccctgtgtccttataaattct

SEQ ID NO: 1303 - DNA, 201 bp, Homo sapiens
acatatgcataacttatcttcactcttggaccacaaagatctatttcagagacaaatttggagtggaattttccttaacattatcctcaatagagcctaargtatagaatacactcattttctcactcatatcctgagacctcagtggtcgtttaccagacgttggaattcctaaatgaataccattgccttaaaaatcat

SEQ ID NO: 1304 - DNA, 201 bp, Homo sapiens
agaagatgacccatttgactctaggacttcagatgtaactcttatggcaaaaggaaaatctttgggaataacaggatacaaagctttctcagcaagagcaycaggcccaagttctcttctatttataccggtgactttgacaatttcattagttgcataaggaggaaactcatagtgcagcatgaaatttttatcttttat

SEQ ID NO: 1305 - DNA, 201 bp, Homo sapiens; identical to SEQ ID NO: 704

SEQ ID NO: 1306 - DNA, 201 bp, Homo sapiens
ggcacagcatttgtcattgcttctgcctgccccttaataaccatatccacctgcttgtgtcttttaactgagttatcagtcacctcctccatgaagctgtygcaagctttctcaggatgacgcccctcttgctgcattgttgcctggtctgtgcctctgtgtagaacttgccacattgcattatggccagaggcttgtgtg

SEQ ID NO: 1307 - DNA, 201 bp, Homo sapiens; identical to SEQ ID NO: 300

SEQ ID NO: 1308 - DNA, 201 bp, Homo sapiens; identical to SEQ ID NO: 707

SEQ ID NO: 1309 - DNA, 201 bp, Homo sapiens; identical to SEQ ID NO: 708

SEQ ID NO: 1310 - DNA, 201 bp, Homo sapiens
cagatacctcatccaagatatacaggtagcaaataagcatatggaaagatgctcaacatcatgttattagagaaatgcaaactaaagcaacaataagacaycactacatacctattagaatggctaaaatccaaaatgctgacaccaccaaatgctagagaggatgtgaagcaacaggagctctcattcattgttttgtcc

SEQ ID NO: 1311 - DNA, 201 bp, Homo sapiens
gatgtgaagcaacaggagctctcattcattgttttgtccttacaaaactaaataaactcttactatataacatggaaaatgcatgtcttggtatttatccraaagggctgaaaaactatgcacacataaaagcctgaatgtagattgtatatgctttactcataattgccaaaactagaaagcacctaagatgttatccaa

SEQ ID NO: 1312 - DNA, 201 bp, Homo sapiens
agctctcattcattgttttgtccttacaaaactaaataaactcttactatataacatggaaaatgcatgtcttggtatttatccgaaagggctgaaaaacyatgcacacataaaagcctgaatgtagattgtatatgctttactcataattgccaaaactagaaagcacctaagatgttatccaataggagaataaataaa

SEQ ID NO: 1313 - DNA, 201 bp, Homo sapiens
atttgcgctctttgacaatgcaatggtcactcaaaagctctggtggagacatacaaaaagattaatgttgttttactgctaacacaacatccattatgcaycctgatgaaggagtaatttcacctttcaagtcttattatttaagaaatctatcttgttaggctgtagctaccatagacagtgattcttctgatagattag

SEQ ID NO: 1314 - DNA, 201 bp, Homo sapiens; identical to SEQ ID NO: 970

SEQ ID NO: 1315 - DNA, 201 bp, Homo sapiens; identical to SEQ ID NO: 973

SEQ ID NO: 1316 - DNA, 201 bp, Homo sapiens; identical to SEQ ID NO: 974

SEQ ID NO: 1317 - DNA, 201 bp, Homo sapiens; identical to SEQ ID NO: 979

SEQ ID NO: 1318 - DNA, 201 bp, Homo sapiens; identical to SEQ ID NO: 980

SEQ ID NO: 1319 - DNA, 201 bp, Homo sapiens; identical to SEQ ID NO: 981

SEQ ID NO: 1320 - DNA, 201 bp, Homo sapiens; identical to SEQ ID NO: 984

SEQ ID NO: 1321 - DNA, 201 bp, Homo sapiens; identical to SEQ ID NO: 985

SEQ ID NO: 1322 - DNA, 201 bp, Homo sapiens
atttttggtgggcagcaactggctggagtaaagggcagctgtcccttactgagagcacccattctccagttcacacagtccccagaggtctactatctgaytcacggagcggacttcagatacgtcatccacctggcccttggtaggcatttgtgtttgtgactacagctgaagtcaatctaagtcatgaactgctacatg

SEQ ID NO: 1323 - DNA, 201 bp, Homo sapiens; identical to SEQ ID NO: 263

SEQ ID NO: 1324 - DNA, 201 bp, Homo sapiens
tttcccactgctggacagcaatctgtccaatccacagtcacataagaatattcctttaaggccgatgcctgcttagccagttaaatccaaagacagtgttygtaggaaagggccaggttaaatggtatttttaaggctaatttgggattgaccttattatcattggataatcagttaaggaaacaaaaaagtatggattta

SEQ ID NO: 1325 - DNA, 201 bp, Homo sapiens
aaatcctataaacagcatgtgatcatattgcttctagaatttatgattgttttcttccaaaaggaagctaaatttagcctagtaattctacatgcgctcargaaaacaatgcctgctgtgatttctagaataaatgaatgtgaaccacagttcctttacttgactaacagagaaagtttaaatatcaacctagtcattaac

SEQ ID NO: 1326 - DNA, 201 bp, Homo sapiens
atattttagttggcaagacaacatgaataaagacattctgtttaatttcaaaaagtggtaattgtcaaataagggtttgtacatgaaaatacaggattacrtggaactaagacactggcgccgatctttaaaaatctatttaaaacctcaaagggaatactttttctgttcctttgctattagtgagtgcctgttcaaata

SEQ ID NO: 1327 - DNA, 201 bp, Homo sapiens
agtgggtacagagatgccagcttgggtttgccattgttagaagtgaagatgacacctcagtgctgcagattttgcaggaggggactggagccaagccacaracttttctctgttaggagatgggttcttggagtgggtgtggtgtctgaccatccggggagatggctgaagctggggatctgggaaggctcccagaaggga

SEQ ID NO: 1328 - DNA, 201 bp, Homo sapiens; identical to SEQ ID NO: 1260

SEQ ID NO: 1329 - DNA, 201 bp, Homo sapiens; identical to SEQ ID NO: 1261

SEQ ID NO: 1330 - DNA, 201 bp, Homo sapiens; identical to SEQ ID NO: 1262

SEQ ID NO: 1331 - DNA, 201 bp, Homo sapiens
ccaatctcagtaggcattctgtggtttcccctctgagtgtccttgctctctgtatctggaggtggggtatttttctgggtgtgtcagactctgcgtgactyggtttctccccgtgagctcttcagtctcctgaacctcttactgccttgtccctgtccccgtcagtctctgcacccagcctccctgtctctcagtggagtg

SEQ ID NO: 1332 - DNA, 201 bp, Homo sapiens
atgactttccatgcatcatctcaacaacctggggaggtggggccagcaccagacctagcttcacagggcgccaggctaagagggaccttgtgtttgattcracactctgctgttgccgtcttgaaagttttaattgttttcaacaaggggacccacatcgtcattttgtactggggtctgtaggttatgtagatggtccta

SEQ ID NO: 1333 - DNA, 201 bp, Homo sapiens
acttaatacctgtcctctcttcctgtcctgaaccccagcaccctagccttaacccctgacctttctaccacataatcctgacagctgacctctgaccattrtccccaggtgactccgcagctaccatcccaactctcaccctgacccactgccctgggactggcccagccctgtcagttctgacacctgttaagcccagca

SEQ ID NO: 1334 - DNA, 201 bp, Homo sapiens
gcaatctagatcttagagaagtggcctttgtaattctggatatacagagcaaaatctgctggtactattcgataaaataaatgcttgtgaataccttctaygtatgaagcaacataccaagatgatgaattctgtcttaaaaagagcttggtcagtagtggacattaagagcgaagtgtaaaacatggagaccagtattta

SEQ ID NO: 1335 - DNA, 201 bp, Homo sapiens
tttgggtcagatcctgcctggctttctccttcttttgctttcagggtcaaacaactgttctttagaagacagctgcaaggactattattaatattaatatsaatggtaacaacagctcccatatattgaacatttactatttcctcattatgcagaacatgttatctcactcagctttgaaaacaaccataaaaggtagaa

SEQ ID NO: 1336 - DNA, 201 bp, Homo sapiens
attttggtcaacgttggactgcatataccacagtggtcccctacgattatagtggagctgaaaaattcctcttgcctactgatgttgtagccatcataacrtcgtggcttaatttgttatcttttctatgtttccatatgtttagatacacaaatacttaccactgtgttacaattgcctgtagtatccagtatagtaaca

SEQ ID NO: 1337 - DNA, 201 bp, Homo sapiens
ggctcaactttcctgctgccttctacgccaactaccatttcactttattcaccgttttggatttgaagctgctgcttgatactgacattttgtagatgtartatggctatgccggtacgtttctgcctattgaagaagatcatgttcttttagtattaaacagtacagttgacttccaatcaattagtttatatataggaa

SEQ ID NO: 1338 - DNA, 201 bp, Homo sapiens
tggctatgccggtacgtttctgcctattgaagaagatcatgttcttttagtattaaacagtacagttgacttccaatcaattagtttatatataggaatcytgtgtagcctgcagtggggttgtggggagcaaggcagaagcagccactccagagaggatttacatttatttcttccaggcatctgagagatcatttcaga

SEQ ID NO: 1339 - DNA, 201 bp, Homo sapiens
gggttgtatctccagaagccccatcgatgtcaggttgggcagagccagcccaggaaacatggaacatctgcctctggcctctcacctctttgttctcctaygaagcccggcttttttttctttttttgagacggagtctgctctgtcacccaggctggagtgcagtggcgcggtctcagctcactgcaagctccgcctccc

SEQ ID NO: 1340 - DNA, 201 bp, Homo sapiens
accctatgagattactattatccttaaagactgaggcgcaatgaggttttatttgtccaaggtcacacaatcagcaagcagcagtgcttaataaggacctsagacagactccaccaaaaagagctcacaatttgaaagcaagccccattcaataaatgatgctgggatcactggttatacatagggaaaaaaaatgaaact

SEQ ID NO: 1341 - DNA, 201 bp, Homo sapiens
tttttttaagttttatttattttaggttttatctattattgttactattgttcatctccatttccacccttaattccaacaacacccttataacaatcctsttctccaagcaaagtggactctttaccatctcctaaatacccacctctgtgtttatgctttcactcagcctggaaaatacagcactgtctcatctccaag

SEQ ID NO: 1342 - DNA, 201 bp, Homo sapiens
ctcacccaatctagtgagaagtaagagagtaaactagctccatatctctcctttctccccatgctgatcctacacttcacaatcaggcttcctttcctaaygtacagctttcatcacatcactggcgaaaaacatttgatgacttcccactacctagtcaatcaagttcaaacttcccagcttggaatagaaatgggtatt

SEQ ID NO: 1343 - DNA, 201 bp, Homo sapiens
agcccacaaaactgaagaactgctattatactagaagaaaaaatttatgaaattcaattttaactagtagctagtggcactataaactggtagttgttctraagaataatctgacaatgtggctaaaaagtgatagcctcagacctaatgaaatcattttagggaatatattctaagaaaaaaactggaagaaaaaagatt

SEQ ID NO: 1344 - DNA, 201 bp, Homo sapiens
tatagttaatttattaactgataatgaatattataactgacatagaatacacaattcatcacaaagtaaaggtatggtcctggccttctgctttatagagwttgtatatcaaataaagcatatgaccaactctagggctgcattcctccttccatcaaagccatagtatttcatttgtgtatacatctaaatgtaactcta

SEQ ID NO: 1345 - DNA, 201 bp, Homo sapiens
gtgctggctttaggtctgacccagtgtagtttcagtggtggggtggccacaggggtgcttgtgtaacctctcccctagctccaggtagctcagcatagacrgacaaattccagttgtttgggagagagtaagaggagagaacaagagtctctccctggtaatccagagaattattctggattttacctaaaaccaccaagg

SEQ ID NO: 1346 - DNA, 201 bp, Homo sapiens
tctgctgacacctctgatttccttaaccaaaaactacaccacacttgacagctttgcaatggtttccaaaactctattactctgccaaaaaaaccttttcrcccttattatcaatgagaattctcccctcattttcctttcacttttttttttttttttgagacggagtcacgctctgttgcctgggctggagtgcagtgg

SEQ ID NO: 1347 - DNA, 201 bp, Homo sapiens
tgccctctgaatttggtgctcattaatattaactgatatagttaatttattaactgataatgaatattataactgacatagaatacacaattcatcacaargtaaaggtatggtcctggccttctgctttatagagattgtatatcaaataaagcatatgaccaactctagggctgcattcctccttccatcaaagccata

SEQ ID NO: 1348 - DNA, 201 bp, Homo sapiens
tcaaggcctcgatattcccttccttcaagaggggccaaactttctgggcttttggtaatggagtcactagctccctgtggctacatatgggttgggatacrtgaattgtgctgggtggacactagttgggggtggccccaccttcttaatccctgtagatctcccacccccatcccaccagagaagccagcatcttaagcc

SEQ ID NO: 1349 - DNA, 201 bp, Homo sapiens
tctgcagtagggggcctccctcttcatcttcacccagggaaggattggttaagggcttacctcggtctgggtccaaccctcagtgctcatccttaagggcycctgggaactgacagctccctcccttcatcatcacctcccactgacctgctgtctcactgagcccaagcaacctgatcttcctcctacccctggatgctg

SEQ ID NO: 1350 - DNA, 201 bp, Homo sapiens
acagatgcgttttggagtagtagactgatttattagctagttcaacaagtcgcttaacccttgtgtgctgaaaaatgtgctgattataggctaactagggmcagttgaggaaggcttagaaattttttttttgttttggaaacggagtttcgctcttattgcccgggttggagtgcaatggcgcgatctcagctcactgca

SEQ ID NO: 1351 - DNA, 201 bp, Homo sapiens
accactctcaactctcagcttgtagaggtccctcttgggtcctcctcttgtggccctctccacacatagcatttggtccttcatgggagcaccagctgctsgaaaaaatgattctgttaggtaaaaatactatacatttttgaaacatgcaccaattatttagctctgtgattgtgggcaatttcttcaagcagcctgagc

SEQ ID NO: 1352 - DNA, 201 bp, Homo sapiens; identical to SEQ ID NO: 986

SEQ ID NO: 1353 - DNA, 201 bp, Homo sapiens; identical to SEQ ID NO: 265

SEQ ID NO: 1354 - DNA, 201 bp, Homo sapiens; identical to SEQ ID NO: 610

SEQ ID NO: 1355 - DNA, 201 bp, Homo sapiens; identical to SEQ ID NO: 611

SEQ ID NO: 1356 - DNA, 201 bp, Homo sapiens
ttaaaaattcaaaaggtgatttagttcaaaaggttatttaggtcaatctccctacctccagggagaagtattcttaagccccttccaagcacaggtctcayctaaaatacggcttgtttttttatccatataccatttcagtacatctccaagaggacaggaaaatgcatactgtgactgagttcctgctgtgatggagcc

SEQ ID NO: 1357 - DNA, 201 bp, Homo sapiens
caagaatactatttgcaaatgcaacataaaaactatattagctggagtaattctgcttttgtgataaagaattgctgctacttttccctctgcatttccarttgttcttataacactggcattaattcaaggaatccataaaaggagaaaggttggtcttttcattttggatttttttcaccaataagacaaacttagctc

SEQ ID NO: 1358 - DNA, 201 bp, Homo sapiens
acggggttagagttacttacttcatgatagaaagggataagtaaatgtataagtcttattttcactaaataacttagaaaatatctggtcaaacaggttgkactgcttgttagataggtatatttacctatctaggtaaaaaataaataggtatatttgcctattatttataataagaagagctaaatgtaaacatttcca

SEQ ID NO: 1359 - DNA, 201 bp, Homo sapiens
ttggtcctctttacttctctatctataccttctccttggtaatctcaaccagtctcccggctttaaataccatttatgtgctgataactctaagctgtcayactaatttttttcatcagtctaattggaaaactaacaaacaggttaagtttataaatgtccaaaacgttaactcctgattgtccattcattctgactcta

SEQ ID NO: 1360 - DNA, 201 bp, Homo sapiens
ctttgttcatttctttttattcttttttctctaatctggtcttctctttttatttcattaagttgatcttcagtcactgacatcctttcttctacttgatygatttgactattgatagttgtgtattcttcacaaagttcttgtgctatgcttttcagctccatcaggtcattcatgttcttctctgcattggttattcta

SEQ ID NO: 1361 - DNA, 201 bp, Homo sapiens
ctcacaccaggagtgttgggagaccatcaggtgatggtcaggtggttgttaactgtctctctgaagtaataattggtcacagctggcgccagggaacggcrgtctcctagtagatagaaaacacctaaaactggtgacgagcggcttctcaataagatctcaggagttgggcaagtggtcagaagtagtgcaagaccctgg

SEQ ID NO: 1362 - DNA, 201 bp, Homo sapiens
aaagcttttaagtaaactttcactcctgctctaaaacttgcctcagtctctccttctgccttatgcttcctcagttgaattctttcttctgaagaggcagrtactgaggttgctgcagacccatatgaatttgccatgggtaacactatcacactgtatattagactccttccccgccttttttggaggcaaagtctcgct

SEQ ID NO: 1363 - DNA, 201 bp, Homo sapiens
aactagccaatcctgaacttgttagcccttcctcacccattccttcccaaggaaatcacaatagaagctcttgcccatatttccccctattcttctgtttyctgacccaccctcatgtttccctgtgtggccctgcatgtgcagtgtgcactgtcctcttggggattgtagctatcttttcaatggcaatcatctgatgca

SEQ ID NO: 1364 - DNA, 201 bp, Homo sapiens
aaataaaacaaagattcagtaaattctgctacatagacagaaaggggcaagaccatgtaaagtgttgtctgaggagttttaactactcaggagacattggragccacagaacagtgttaagcaggggcataatatgactagatttacattttaaaaagattactcaggcagcagtgtggttacagaattgcagtgaagtaa

SEQ ID NO: 1365 - DNA, 201 bp, Homo sapiens
tggtaatatattgattctgaatagtaatttgtgtctcagtgtgaccaaattgaccagacctgcttagagactttgttctgttaagacaatagaggaacccmgggctgagacctcaggactatggcgaggagaggaaggagctaaacaatataatctatttctttcacattttcagtggagctggccttgacttcacagaca

SEQ ID NO: 1366 - DNA, 201 bp, Homo sapiens; identical to SEQ ID NO: 618

SEQ ID NO: 1367 - DNA, 201 bp, Homo sapiens; identical to SEQ ID NO: 619

SEQ ID NO: 1368 - DNA, 201 bp, Homo sapiens; identical to SEQ ID NO: 620

SEQ ID NO: 1369 - DNA, 201 bp, Homo sapiens; identical to SEQ ID NO: 621

SEQ ID NO: 1370 - DNA, 201 bp, Homo sapiens; identical to SEQ ID NO: 622

SEQ ID NO: 1371 - DNA, 201 bp, Homo sapiens; identical to SEQ ID NO: 623

SEQ ID NO: 1372 - DNA, 201 bp, Homo sapiens; identical to SEQ ID NO: 624

SEQ ID NO: 1373 - DNA, 201 bp, Homo sapiens
cctcaggtgatccacccacctcggcctctcaaagtgctgggattacaggcatgagccaccgcacctggccttatccatctttttacacagcatcctgaacrttctagaaacaaaggttaatatttgaccagtgagaatatttgttctttaaagtctaaataagttgcatcaaaaaaatgcaaagccatcttctaattaaaa

SEQ ID NO: 1374 - DNA, 201 bp, Homo sapiens
gtctttgctgcttaatttttcagtaagtaatagtaaattgtattttggagggaaaataagagagagatcagcatcatatgtgttaatttaaaaataaagayagcacatgaagaaacaatagggtgacaaagatatatcagtagtatctctgttatctgtaactgcataacaaaccatccacatatgtagtggcgtaaaaca

SEQ ID NO: 1375 - DNA, 201 bp, Homo sapiens; identical to SEQ ID NO: 625

SEQ ID NO: 1376 - DNA, 201 bp, Homo sapiens
ccttagataatactttttcctttttttcccctcaggccctcttggataatatttttaatgggtataaatttcatggttaataacatttcagtctcattaartaaaagtctctattcaaacctagttgataggtccaagctatcagaaagtgaggaaatatttatttataaaataagttaaaatttaaaataaacatttaat

SEQ ID NO: 1377 - DNA, 201 bp, Homo sapiens
actctccttaactgtggcaagaagggatggaaactcccttctgagagacactggactaagcagcctatataagctgcagtgtttgctcgatttctagaaayagcaactatattctttcaatttaaccccctattaagacaaatcaggttttaaaaaccaacacaaccacaacaataaaaatcaggacatacttatcagact

SEQ ID NO: 1378 - DNA, 201 bp, Homo sapiens; identical to SEQ ID NO: 630

SEQ ID NO: 1379 - DNA, 201 bp, Homo sapiens
tctatccctgttcccataagaaagtgctctctctctctacttcttccatttgcttctccatgtccggccatatttaagggtttctggttatttgtggccckacctcttttttctcagacctgcagaccctcaagtaggggatagtgtacaagtaagggatagcgtattgttctcctgctttcacatgttaagcacattgga

SEQ ID NO: 1380 - DNA, 201 bp, Homo sapiens
acaaaaattttaaaatctataagaagttaaaaaaataaaatatttatttacagtttccttcttggattttggcctagaaataactttcttaaccctaaacyggacccattttcacttatattttctcagaatttttcatttcatattttatgttaatttaaaagatgagagatcaaatatggctttgtttcatattagctg

SEQ ID NO: 1381 - DNA, 201 bp, Homo sapiens; identical to SEQ ID NO: 631

SEQ ID NO: 1382 - DNA, 201 bp, Homo sapiens
gactcaagctccaaagaatcttaccaatgtgtaaagagccacctcaaataccactttccactaggaggcatttcctgatgcctccttccggcaacctttgytcccccaaagttatggttatttgggtacttatcttccatcaaatcataaatttgaaaaagagggaactaagttgtatagctctgtaggacccctagcacc

SEQ ID NO: 1383 - DNA, 201 bp, Homo sapiens
gcaaagccaggattcaaatccaagtgactgtagctccaaaaaccatgtactttttctattatctgtctttccaaagtaaaaagcagtgataaattgttctrtctctagtttaacaaattatttaacaattaattgaccaattatttttgtctcaactttcctttgatttcttttctcgctcaatttttaaaaataaaaatg

SEQ ID NO: 1384 - DNA, 201 bp, Homo sapiens
tatccagccataaaaaaatgtgattctgtcatttgcaaaaacataatggaattaaaggtcattatgttaagtgaaataagccaggcacaaaaacattgcaygttctcccttacttgtgagatgtgaaaatcaaaacaattgaactcatggagatagagagtagaaggctgggaaaggtagtagggggttgtggagttgagg

SEQ ID NO: 1385 - DNA, 201 bp, Homo sapiens; identical to SEQ ID NO: 633

SEQ ID NO: 1386 - DNA, 201 bp, Homo sapiens; identical to SEQ ID NO: 1012

SEQ ID NO: 1387 - DNA, 201 bp, Homo sapiens
agagataattgtaaaagcaacaacaacagcaacagcaatcatggctgtatgcttatttgaacaagactagaaatgagagcagaaatttgaaaagttaaagyatttgaatgaccaccagatggcagtgtggggccacctggaagctgaagccaaagtcgtcgttctgtctctctaggcagcctctgaaagtgtcagccccaa

SEQ ID NO: 1388 - DNA, 201 bp, Homo sapiens; identical to SEQ ID NO: 913

SEQ ID NO: 1389 - DNA, 201 bp, Homo sapiens
attccagaacctttcatcacctacaaggaaattgtgtgatactcctcattctcccctcctccaagcccctgataactacgcatctactttctgtctgtatraattggtctgtgctgaacatttcatgtaaatggaatcatacgctgtacggacgctatatggacttttgtggccggctgtccccatgcagcatcatgttat

SEQ ID NO: 1390 - DNA, 201 bp, Homo sapiens; identical to SEQ ID NO: 932

SEQ ID NO: 1391 - DNA, 201 bp, Homo sapiens
tggcttcctgtaatggaaacacatatatccctcaaaacatagaccaggaaaaataatgcaaaagttaaataaaatacaaagcattcttccaaaacacataygttctaaatgaaagtcatatcacacgcaaattagtcttggctaatttcttcatagttccaaatttttaggttgattttaattctttaaaaaaatgcaata

SEQ ID NO: 1392 - DNA, 201 bp, Homo sapiens; identical to SEQ ID NO: 767

SEQ ID NO: 1393 - DNA, 201 bp, Homo sapiens
aaacaaactttctgaaagtcccacacaacatttctgattaaatctcactggctaggacttgccttcatagccacacataactgaataaaagtctgagaaawgtagcattttatgtggatgcatcccctacaccttccccactgacccctgccaaaaaataaaaataaaataaaataaagtgaaagaggagaatgcttattg

SEQ ID NO: 1394 - DNA, 201 bp, Homo sapiens
ctcaaatccaagtctctcttaaaagatgttgaacagaaagtacttaaaggaatatcttacatttttcatccatagttcaagttaaatgatagggtaatacyaacacattagctgtcctttatacatattaatcaataatgcagttttattatcaataattgatttaagtctcagtagtggacaattttaaaacagtctaaa

SEQ ID NO: 1395 - DNA, 201 bp, Homo sapiens
gttaatgagtgtagacctcagagatttaaaatgaactatctgcaaatctgtgacattacactagaataaatgttttattaccccctcaaatccaagtctcwcttaaaagatgttgaacagaaagtacttaaaggaatatcttacatttttcatccatagttcaagttaaatgatagggtaatactaacacattagctgtcc

SEQ ID NO: 1396 - DNA, 201 bp, Homo sapiens; identical to SEQ ID NO: 768

SEQ ID NO: 1397 - DNA, 201 bp, Homo sapiens
ccaatcttaggttctacaaacagtgctgttatctataggaggaattggagaagttacaaaccttgtgacctctagaacaatggtcagttattaattacacytatgtcttctcagaattcaggcccctatctcatggtcctaaccttgtggcttttctttagttttacaaaggcagtttagtattcggaaggattattatca

SEQ ID NO: 1398 - DNA, 201 bp, Homo sapiens
cacattttgattggtccacacaatcaaaccagaagaatgttccagtttattgaatttgtctccttatttaagaaaaagaaaattaagccaggagaagttarcgctccatccaccagctgggtctttgatgaagggaagtgaaatgaggattctgcacaggtgggcggtagctggtggagtgagcgccctgcaggtgcaagt

SEQ ID NO: 1399 - DNA, 201 bp, Homo sapiens; identical to SEQ ID NO: 771

SEQ ID NO: 1400 - DNA, 201 bp, Homo sapiens
gtggggtatggaatgtgggcatccctaggttcctggaagcagctcttatgctactcatagagatgggactgattttattttttatagcgcttaattcaccrttatgggaaatgcttccaatcacaaaaattcagcccagctcgttttgaggaagaggcaggacatgttatagttttatacaactcatttccattaaactga

SEQ ID NO: 1401 - DNA, 201 bp, Homo sapiens
cattctgaccccagtgaaagtggactctggtactttcatttagtcacaggctcgctcagggagtcttgtttcttattcctcactaatagtcccagtcatayaagcacttgagattattttggctccatcctacttccctgtagctactatggcctcccactctctcatggacattcatcgtattttgctcttgcaacattc

SEQ ID NO: 1402 - DNA, 201 bp, Homo sapiens
acgttttgcatatagttacacaggtttcccaactgaaataactaagagaaataaaaacagagaaaaacctgcctctgtgctggaaggagggaagggtgacmtgtcaataagtgtttgttgaatgagtgaatgaatcatgcaaaattctaatatcttattaaaataggagataacctgccatagctaggacccagaaataaa

SEQ ID NO: 1403 - DNA, 201 bp, Homo sapiens
aaatgaactggcaaaatctgtaatgttacaaagtaataaaatgtaaaactaaaactatggcacatctgaaaatcaagaatgacttgtttggcccacattayaattcctgtatactagaataataatatatgttatgtcataatttttcataaatgatttttcaaaattcagcaataattttaaataaatgtgtgcatatat

SEQ ID NO: 1404 - DNA, 201 bp, Homo sapiens; identical to SEQ ID NO: 789

SEQ ID NO: 1405 - DNA, 201 bp, Homo sapiens
atatttttcctttgaagctattctcagaaaaatgtgatctaacagtctaagaaataccgatttaggttaagtttatcttatagcaatgcagacagttgtgytggatttcaccctccagccaatggcctgtttactgggttatatgcaactgtacatttccgcaacaagtctttctaattagcattcataatgaggttttaa

SEQ ID NO: 1406 - DNA, 201 bp, Homo sapiens
ttcaggtaaggtataaaaaatgtataatagatttattcccaatctactgcacttgaggtacaattaagatctacttaggaataacattaaaatctacaaasgtttttgaattaaggaactttcatgatcgttgccagagagatctaagtttgcaaaatatttttcctttgaagctattctcagaaaaatgtgatctaacag

SEQ ID NO: 1407 - DNA, 201 bp, Homo sapiens
ctatcatagcccttaccacgtcgtatacaagtcactggtttatgtctccattaactttaagctcctttatatcaagatgcatctttatccatgtctacatsttcggacctaacgcagtgcttaacccataacagatactcaacacacatttgtaggaaggaatgagtggttgaagcttgccgttctcctctctctccatcg

SEQ ID NO: 1408 - DNA, 201 bp, Homo sapiens
gcagcatatgtcagctccttaggcgaggatttcggccacccaggcaagccaccaaagagtgacaaccgtagagtgtagataatgtctaatgatcttcgtgsctcgctgaagccatttaaatcggaatgctgtgccctttatcatctgtttcttcttccttcttgatctactggaagatggatgatcttctcctaaatgaat

SEQ ID NO: 1409 - DNA, 201 bp, Homo sapiens; identical to SEQ ID NO: 1301

SEQ ID NO: 1410 - DNA, 201 bp, Homo sapiens
caaagggtattgagaagcagataaagatgagaatgaacaaagacctgggaaatccagtgtggcagtctgttctccagtatctgctttcttctcttccttartggtgctagattttaactggacacatgactgcagagaaaaaaatcaacatttctctacttccctggctgctaggcataggcaagtgataagtcctggcca

SEQ ID NO: 1411 - DNA, 201 bp, Homo sapiens
cattatttctggaggtttattggctaaacaaatatttctggagcatctctcatgtttctggagatctgggaatgcagagatgggcacaatctggtctttgyctttgaggatttcacaatttagtggaagtcacaggcacataaataactggctgcaagtcaatgtgataggtgctattgtggaacagtaacagaggagaga

SEQ ID NO: 1412 - DNA, 201 bp, Homo sapiens
cctttttatcaaggcaagttcagcacaagcctacagcttacacaactgacgagggagttagatcatgaacaaggaaaccatgtacaaatgttaaggttgcrtctttaaaaatagttaataaagtacacatactttttaagaacacactccccttcaaatttacttattttataaaatagttcattatgggatttctttaaa

SEQ ID NO: 1413 - DNA, 201 bp, Homo sapiens; identical to SEQ ID NO: 1302

SEQ ID NO: 1414 - DNA, 201 bp, Homo sapiens
agttgttaaatggagtaataatcatattcaacccatagagttgttatgagaatcaatgaggcaatatgatacgtagtgcctgccacatgctagccattcartaagtgagagctacaaagaaagtgaccaaagcctgagggattggcagagataagaagagtaggggccaggcagccaggaacctgcattggagcatgtatg

SEQ ID NO: 1415 - DNA, 201 bp, Homo sapiens
tttttgcagttccaggacatattcaagcagagtttggataaccacctgccaaagatctgtattgggtgggaagttggttcatacctgtcttaattgtccargattctattcttcacctagattatctctgtaaatcatgaagtgcttactaaaagtattatatccaaatgaatattcaagtaaaaatataaacaataaaat

SEQ ID NO: 1416 - DNA, 201 bp, Homo sapiens
ataaggatccaacacccagtcctcttcccaaaatattattacactgaaaatgaaaaacatggcagtttgaattctcagaagggtcctatatggattcagaytgttcttcttgtaaccaggattcaataataatcaagtcatatacttaacagacctcaactgaatgtctgctatccacaactctaaaggtatgagctattc

SEQ ID NO: 1417 - DNA, 201 bp, Homo sapiens
tgctccacaagagaggctatataaaatgagaacaaatcttttgtggattgacaatctagatgaactattcttaatactttgtcccctgcgtcgtagactgrttgattttcaacttttggttgtcttaaaagggttgaagcgtaactcttcagaactgtaaggaatacactctgtgtcctactgtctctaaattttgggaga

SEQ ID NO: 1418 - DNA, 201 bp, Homo sapiens; identical to SEQ ID NO: 1303

SEQ ID NO: 1419 - DNA, 201 bp, Homo sapiens
tatggagtcagggaattaagaccactagaaatgaatgcctcagatgagtaattaactaattgccagaattattccaaatcagtcataaaattcaaaatcarcattttaaaattctaggtttgcctaactaaaaacattagtgaaattattcatgatattatttactctttaaaagtttttgaagtaaaaactctctctgcg

SEQ ID NO: 1420 - DNA, 201 bp, Homo sapiens
ggtgcacctctgggtaagaaccactgggtgaatgtagcctactttcaggtaaggtataaaaaatgtataatagatttattcccaatctactgcacttgagrtacaattaagatctacttaggaataacattaaaatctacaaaggtttttgaattaaggaactttcatgatcgttgccagagagatctaagtttgcaaaat

SEQ ID NO: 1421 - DNA, 201 bp, Homo sapiens
atattttaagcatccaactgttaagttgttaaacttaatattgagtatcaccactattcagtactagtcctttaatttctttcaacgactttagtctccaraataggttctttaggcttcttctgtctcctaaaggcaggaagatagtagccatctatttcctcatatttctaatgaggttctaggttcttctaattactc

SEQ ID NO: 1422 - DNA, 201 bp, Homo sapiens; identical to SEQ ID NO: 810

SEQ ID NO: 1423 - DNA, 201 bp, Homo sapiens
ggaaggtgggcagtgcaggctctcattactcaacgtgtagagcacattgaaggcctgttctccaggagaagaattgacgagttaacgtggacatgaagtaktttcccttttgtccatgtcattccagattgtgatggtcaaaacaaagaaagaaatttggcagctgggaggccgggcacaatggcagatgcctgtaatccc

SEQ ID NO: 1424 - DNA, 201 bp, Homo sapiens
caacgttcctccctcagccagccactatggggctaaaatgagaccacatctgtcaagggttttgccctcacctccctccctgctggacggcatccttggtrggcagaggtgggcttcgggcagaacaagccgtgctgagctaggaccaggagtgctagtgccactgtttgtctatggagagggaggcctcagtgctgaggg

SEQ ID NO: 1425 - DNA, 201 bp, Homo sapiens
gtttgtctatggagagggaggcctcagtgctgagggccaagcaaatatttgtggttatggattaactcgaactccaggctgtcatggcggcaggacggcgwacttgcagtatctccacgacccgcccctgtgagtccccctccaggcaggtctatgaggggtgtggagggagggctgcccccgggagaagagagctaggtg

SEQ ID NO: 1426 - DNA, 201 bp, Homo sapiens; identical to SEQ ID NO: 683

SEQ ID NO: 1427 - DNA, 201 bp, Homo sapiens
ctcaaaaacactctgcctttagaaatttcagcatctcagccctttacaggtacttattaggtctctggacctatttcatcttgttctactcttttcctccycactatgctctaggtatactggttttcttgccattactttagcatgccaaacttatttccaagtcaaggcttttacacttactattccccctgattaata

SEQ ID NO: 1428 - DNA, 201 bp, Homo sapiens
tgcaagaaacacagaaatcagagtgaccattataaggcctgttggatcaggcatgccaactgtccttcaaaaccctccagtgctcactcagaataaaatgyacatcgctcacaatgatacaaatcaaatctgttcctctgatctacacagttctgtgctaactgggcctgtctctctgctccagccacatcagcattcaag

SEQ ID NO: 1429 - DNA, 201 bp, Homo sapiens
taagcgatatttcttcaatatttcccttcttggacttcacattgatgatagtttttaggttgtaataatttagagtttggatggtctacatttaccatctrcagttgtttactccctctttttttaatgcacaagtgatgaaaatgttgtcatgtaatatctaaacaatgataaatacttagactatatataaaaatatat

SEQ ID NO: 1430 - DNA, 201 bp, Homo sapiens
tcccttttgaaatacattatattgaactgactgaaaaagggagaaaaacatgtttcagtggttgaagaacatggtagatgaagtagttcattttgaatggytttagttccttaacaaaaaagtcagtggtgaagttgcatattttagtataatatttaggagctgcagttggggaatttgaaatggcttttgtgaattatt

SEQ ID NO: 1431 - DNA, 201 bp, Homo sapiens
aaaattgtttttaacagtaactgataatatatggtttgaccaccacttaattaaccatttcttttttttttgtacatttagaatgttttcctccagttcasatatagacagttaataggaaacagttatattatttaatgctcaactttgttccttagctgtgcctttaattctaagagtagttgctagctaggtatttta

SEQ ID NO: 1432 - DNA, 201 bp, Homo sapiens
cgtcttccaagctccctgtatgtgctccattgatgcagcttaaacaattcttaaacctggtaagaaacacaaataattgtaactctagaacaaaagtattyaacccaagaacacaatacataaagagtaattatgaaaatagcactatgtgggtttttaatgatacctcctgcattcatcagcaaagaaaagtttctttaa

SEQ ID NO: 1433 - DNA, 201 bp, Homo sapiens
taagtcttccttggataccatctcactgctccttgctcttctgaggacaagtatggttgaaaaattctttggtaattctgtttagtgttttgtcaagttcsagaattaaagttcattgcgggtggaggcagtattttctaactctttgtcctctaccgggctgtgcatatgggaagtactcaatacatttctttagtaaat

SEQ ID NO: 1434 - DNA, 201 bp, Homo sapiens
ttgggaataaaatgggatctcaaaatcagattccattttgcacccaaccacaactgagaaaactgaggctcaaaaaagtgaagtcattgacacaaggtgtygactattaattgctgagtcaggatatgaagcccagttagtctgattccaaaacttatattcttcctggtggatcagacagaaggaatgggaaaatgcaat

SEQ ID NO: 1435 - DNA, 201 bp, Homo sapiens
tgtctgcagttttcaaatgtttattaagtggcttggtatgcatttcgttgggcttatttatcctatttgggcttctctcagcttcttcaactgaaggtttrtatctttgctatgcttgtgatgtttttaagccattatttcttcaagtactttttttttttaagttcagctttttattgaacacattataaaagaggtttc

SEQ ID NO: 1436 - DNA, 201 bp, Homo sapiens
taagccattatttcttcaagtactttttttttttaagttcagctttttattgaacacattataaaagaggtttcgtcaaaaagaccaaagcccatgtcacyatcagacttctcggattcttctttctttgcttccactttcttctcctcagctggagcagcagcagcagaggcgggcagaagctcctgctggtacagatag

SEQ ID NO: 1437 - DNA, 201 bp, Homo sapiens
tcctgtagacacatttaccaaccaagtgaaacatggcgtcttgtcggccttaaccgctagacttgagagaatggaattttcatgaaataagagtgccgatycataaaatacatgccattcgttttgatttaaattataaacaatcttatccatggtcttcttttatttttattttttaattttcccttccattctttgatt

SEQ ID NO: 1438 - DNA, 201 bp, Homo sapiens
ggcccccccgactaccatcacccagggatttcaacttaccctccgttctttcttgggaattacagtagtaaaataaagaaggctactaacagtagttttgygaacatgagaacaaaatcatcgtaggaattctgaagaaagaaaaaaagactaaactgctagacaaaagaggatagtaagactttatgtgggtcaccctta

SEQ ID NO: 1439 - DNA, 201 bp, Homo sapiens
tgttgtttgaaacaatttgaagagcatacagaaaagatctgtttttattgacctgtaatatacgagttgaaatacataggaaattgctctaacaaaatggwgtatccagaatgcaacaggtaaatataacatcaaatccaaggaaatacattactttattccaaaagacattatgtaatgtacctttgggtcagttgggtc

SEQ ID NO: 1440 - DNA, 201 bp, Homo sapiens
aattaaaaccttgcatcttcgtatactgttaattctaaaccattttaaggcaataattaccagaggcaggaaccacagctatgccgagttcctctctatcratagaagggtgtgttacataggttggcatatcactgaccttttctgcagtcactgtaatgccagcttttcataactattgttttctgttttctcagaatc

SEQ ID NO: 1441 - DNA, 201 bp, Homo sapiens
tatttccctaccctctggcaaggtacaatgaaaacaaattagagttctgtggtagagctccttggctgttccttgagcagacattttctcaagatcatggsgatttaactagatttttaatctttgttgtgtaagttccagaaatcataaaaatatctcttcagacgcaaagcaggcattttgtctctcttcaaagcccaa

SEQ ID NO: 1442 - DNA, 201 bp, Homo sapiens
ccagacctccttaaacatgaattcatgcctaggtctccagcctgctgtcctgctctatgaatttcagaagtaccagttctcaaaattgtgtgagcaaattyctcaaaatctctatctatctatctatctatctatctatctatctatctatctatcatcgatctatcatctattatccatctatctatcatctatctatat

SEQ ID NO: 1443 - DNA, 201 bp, Homo sapiens
actatgacttcttgcatattatcatcagagtgttaaatatatctcagaaacctagaatgtttttatatagtggtctactagcactggaacgataataaagmggtcatttttattgatctcctatggacatgacagcttgctcagtggacaataaaatatatattttgtaggtttataggtttgtaagggtcttaatggtta

SEQ ID NO: 1444 - DNA, 201 bp, Homo sapiens
caaggatgaagggaaaaggtcttagttcagtgtacaaaggaatttcttaaaaaattacagacttctttcaggactttacgactaattaggtataaaggttmtaagtaggagagattaaaaaagaagtcaaggtttctagcccggaagcatagatgaatagaatgatgaaaataagagcagaaatgggagatttagcaactg

SEQ ID NO: 1445 - DNA, 201 bp, Homo sapiens
gagcagcattccttccttctgggtatggggcagagctctctctggactgggggtcttaggacctacagtccaacaaggcaggtcagataacttctttatgrctacttttacggctggctttgaggagaaggggttctgatttccatgacccgcctcgggccagagggattctagtctctggggagaatggaacaggtcagg

SEQ ID NO: 1446 - DNA, 201 bp, Homo sapiens
aattgctctaacaaaatggagtatccagaatgcaacaggtaaatataacatcaaatccaaggaaatacattactttattccaaaagacattatgtaatgtrcctttgggtcagttgggtccatgcctctcttatggttgcccgccatttatgcaaaagcagaatccaggtctgaaatagttgttcaaaaaggtgcaggaca

SEQ ID NO: 1447 - DNA, 201 bp, Homo sapiens
tacattactttattccaaaagacattatgtaatgtacctttgggtcagttgggtccatgcctctcttatggttgcccgccatttatgcaaaagcagaatcmaggtctgaaatagttgttcaaaaaggtgcaggacacgtatgtttattgcggcattattcacaatagcaaagacttggaaccaagccaaatgtccaacaat

SEQ ID NO: 1448 - DNA, 201 bp, Homo sapiens
cataggatgatttcaccccaaactctaaaggaatggtattatcaacatcctcggatagcgaagagaattctccacagcataatttgcttttgaccacaacratttcaaaaagttaacaggatgaaaaccacagtataaaagaggcttgtggaactccaggggtgcaatcggttagctcacggtgcttataaaagaggcttg

SEQ ID NO: 1449 - DNA, 201 bp, Homo sapiens
cttctaccatgtgaggccacagcgagaagacagccatccatgaaccagaacgcagaccctcagcagacacaaaggccaccagcaccttgaccttggacttyccagtttcccaaactgtgagaaataaatctttctgttgtttgagccactcagtctattgcattctgttatagcaccctgaatgaacatagatagggtacc

SEQ ID NO: 1450 - DNA, 201 bp, Homo sapiens
gttcttttttgctggaactgcaatatagtgatagaggtgggaagtgaaggcagccagaaactcaaacctgaaaaagcctttatcaacgggaaagatggtckgaaataatggcagacatcctgggggaaataccccctactttggcaatgaaaacttcaacgtatggccttcatgaagacctttcagtacattctaggtttg

SEQ ID NO: 1451 - DNA, 201 bp, Homo sapiens
gtccaagcccctcactctgtagccgggctggcactcaaatttacagctggagccataggcaaaagcagtgagcggatgaacacagtccatggttccttcaytgggggcttccaggtgctgacactgcacagctggagagaataaccaaggataaagagaaagatactgagaaaggagaaaagccacacagagagcaatggt

SEQ ID NO: 1452 - DNA, 201 bp, Homo sapiens
gtcgaggacctccatgtaggtgccacggtggcccccagcagcagaagggactttacctttgacctctacagggccttggcttccgctgcccccagccagarcatcttcttctcccctgtgagcatctccatgagcctggccatgctctccctgggggctgggtccagcacaaagatgcagatcctggagggcctgggcctc

SEQ ID NO: 1453 - DNA, 201 bp, Homo sapiens; identical to SEQ ID NO: 961

SEQ ID NO: 1454 - DNA, 201 bp, Homo sapiens
ctcatcggcgagtgccaggtcccggtcgggcagggagtcctcccagtctaggatggtgtccctcagctctcccctgcaatgaggaagctgaggagagtcckcaggggcctcgcagcctcccctggagcccagggcatgggtgggggtggctcacctgcaggctcgcagcccccttgccttagccacggtgcagagccggcc

SEQ ID NO: 1455 - DNA, 201 bp, Homo sapiens
cctcagctctttcctttccttcaccattctttcttatttatagcttgttttcagcaaggaaagctgctctcatgaatagcaaaccccagccacactgttgrttgacaaatctctacagatggataaggattacagcatgatggttatgcaactcaagatcccctagcccatcttttcttgttttcttttcaactgggggtg

SEQ ID NO: 1456 - DNA, 201 bp, Homo sapiens; identical to SEQ ID NO: 1387

SEQ ID NO: 1457 - DNA, 201 bp, Homo sapiens; identical to SEQ ID NO: 1304

SEQ ID NO: 1458 - DNA, 201 bp, Homo sapiens
cctggcacgcagagtgctggagccaagataactctgcctgtgctgcaaatcacccctcaggtaacaggcacagtgagggtcgtggtgggggtgacagttgkagctggaatgagggttggtcttagaacacccttctccctgcattgatgatcaaatgtctccttgttctccttcctcacaggacgtgcacaaggacccgga

SEQ ID NO: 1459 - DNA, 201 bp, Homo sapiens
gaggcagagattgcagtgagccaagatcgcactccggcctgggccacagagcaagaccctatttcgaaacaacaacaacaaaagaaaggttataagcgccwtggctatgactagtgtcaaattgcttgccattgttttaagaaagccagatacctggattggactctggggtgttctccgagggacaccttcgtcacacaa

SEQ ID NO: 1460 - DNA, 201 bp, Homo sapiens
acttgtattcctctgcaggatttactgtcctgcacataataggaaaataaagccatgttacagtcccacagctatacgagaacacctctcccccacaatgycaaggttagtccctagcagaaaaaaaagcggcaacaaaggaacgtttaaaggagtttaaacatgcaaagtgcttagaacagtgccagccaaatagtaagt

SEQ ID NO: 1461 - DNA, 201 bp, Homo sapiens
gagagaaaggactccagcagactaacatttgggcctctaaggagatggttcagctggtgcagaaacatgtcacccactgctggggtgaagaagaaacctcygggggacattcacttgctggaaccacaggaacaattcaccaccacaaggaatactgccggggccaggtatgtgctgacccattcactgtcatgtggagaa

SEQ ID NO: 1462 - DNA, 201 bp, Homo sapiens; identical to SEQ ID NO: 1348

SEQ ID NO: 1463 - DNA, 201 bp, Homo sapiens; identical to SEQ ID NO: 1349

SEQ ID NO: 1464 - DNA, 201 bp, Homo sapiens; identical to SEQ ID NO: 1351

SEQ ID NO: 1465 - DNA, 201 bp, Homo sapiens
cctgaatgggataggaaggaaaaagtattaagacaaatgtgcttgaaaaatctagcaaaacctcgtgctcagtacacacgataatgatattcaggacaagyatcagtactgtcagtaaggagggccagggtctgaagaaaacatccgtgtatcccctatgcccagcacacacaaacccactttctaactttgctcattaat

SEQ ID NO: 1466 - DNA, 201 bp, Homo sapiens
agtgaatgtgcccaaaacgagtgcatgattcctagaagctctcatgaatcccatactcgcctctatttctagtaatggaggacaggaatttgctgtgcagrgggcattggggaacaactgcttccacttttccttttccctagtacaaaacaaatgtaagctactactattattggcaactgtaacttgtagctcaccagt

SEQ ID NO: 1467 - DNA, 201 bp, Homo sapiens; identical to SEQ ID NO: 1333

SEQ ID NO: 1468 - DNA, 201 bp, Homo sapiens
acacatacaaaaaggattatactccacgcatgatggcttatgcctgtaatcccagcactttgagacgtcaaggcaggaggactacttaagcccaagagtaygcaaccagcctgggcaacatagtgagaccctgtctctacaaaaattaaaaccaaaaattagccaagcatggtagcatgctcctgtagtcccagctactca

SEQ ID NO: 1469 - DNA, 201 bp, Homo sapiens
aaacacaaattactaatatgtggtacataagaggagttattattactgactccatggacttcgaaggatgataaaggagtattatgaaccgtttgccccartatttgcctagcactttgggaggctaaggcgggaggattgcttcagctcaggagttcaagaccagcctgagcaacatagcgagagctcgcctctactaaa

SEQ ID NO: 1470 - DNA, 201 bp, Homo sapiens
atccccttacatacggggcttagtggctagatcacttaggttcctatcccagctctgtaacttgcagctctgaaactttggttaagttacaaaaacctttmgagtctttgcttgtttatctgtaaaacggaactaatctacctcacaggattagtctgaggactaaatttaccttttgagcaccactgttttcaattgttc

SEQ ID NO: 1471 - DNA, 201 bp, Homo sapiens
actgcgcccggcctaaaattgttttaattaaaaaaaaaaaaagaagaagaaagaaggtacagaatagtgtagccgtgtatatggtatatcactctatgtgsggagaaaataaactaaggtggaggtggtggggaatatttacacacacacacacacacacacacacacacacaaaaaaaacaaaacatcttaagcaggaca

SEQ ID NO: 1472 - DNA, 201 bp, Homo sapiens
ggacaaataatcaaatcgaaaaaggtgcaaaacagaaaactggcagaaaaggaactacttataaacacaagaaaaaatatccaatctcagtcatagaagartgaattttaaaaactatgcagagaatttataaagaactcttacaacacaatattcaaaagagatatatctcaactaagaaattgaaaaaggagagacaga

SEQ ID NO: 1473 - DNA, 201 bp, Homo sapiens
agcgagactccatctcaaaaaaaaaaaaaattacaggaaaataacttccaatttatacttctatacccagtcaaactaaatatatgtgtcagaataagacrttttctgatctgcaagctttaaaaaaaaaaaaaaagttacctcccatgtactctttcttgggaggctaccagagagtgtgccccaggaaaaaggaagaca

SEQ ID NO: 1474 - DNA, 201 bp, Homo sapiens
taaattaaaaaaaaaaaaaactaagaaaagaaatatttgaaagatgaaggtccccattttatcctcactatagctccaggcagggggtctctacttcaacytctgaaatagctcccacacctatatacaaccatcagttaccacaataacctgccttgcttttgtggctccagaatattccagcagccttgtatctggtga

SEQ ID NO: 1475 - DNA, 201 bp, Homo sapiens
aaaaagtttgataatgctctgtactgggaaaggctacagacaacacggtggggaagatgaacaagtaatttctttggagggttaatttgtcaacacttacsaatttccattaatgggggactaattaaattacagtatgcctgtataatagaatattatataattacaaaaaggaatcatataattctatatatactagag

SEQ ID NO: 1476 - DNA, 201 bp, Homo sapiens
aacatgggagacagaggttgcagtgagccgagattgtgccactgccctccaacctgggcgacaagagactccatctcaaaaaaggacattttaagtaatayactgtagcaactctggatactgattccccctccttcagggtttgttgttgttatttgcttatttattagtttagtgacttggttagactattttcgtaaa

SEQ ID NO: 1477 - DNA, 201 bp, Homo sapiens
actgattttcaaatgttgaaccaaacttgcataaatccatttggtcatggtatacaatccttgtatgttgctatacttggtgtgctagtattttgttgaakatttttgcacctataatcataagagatactggtcttgtgatgtctttatctggttttggtatcatgataatatgacctcaaagagtaagttgggaactgt

SEQ ID NO: 1478 - DNA, 201 bp, Homo sapiens
agtgtaaaacctctgtacatgagcaagctagggcaaaggtgatcagagccatagaattcttggcctcaagtatgtgggatagagcttccacaccgtgagtmcagtatggagctgggtggaggaaggaagcctctgacctctttgccatactcaccgagaacttagtctcttcaatttggagctggagggaagaagaaaagc

SEQ ID NO: 1479 - DNA, 201 bp, Homo sapiens
gccctcaatgtggacctgacagagttccagaccaacctggtgtcctacctcacatccacttccccctggccacctatgcaccagtcatctctgcagaaaargtataccacgagcagctgttggtggcagagattaccaatgcctgctttgagcctgccaaccagatggtgaagtgtgatccccggcacggcaagtacatgg

SEQ ID NO: 1480 - DNA, 201 bp, Homo sapiens
tttccttttatcattaaagcttatttgtttgaaatctatacaaatacatgagctgaaacaaataaaactcaatccacttgagattttgaagacatctggtrgagttattttctgagtaattagaccaagaggtgggacaattccctgaagtaagctaccctataattggatacccagttatatctgcagtcatcagcttgc

SEQ ID NO: 1481 - DNA, 201 bp, Homo sapiens; identical to SEQ ID NO: 1216

SEQ ID NO: 1482 - DNA, 201 bp, Homo sapiens
gcccttttcagaggttgtgaagttagctccaaatcccagactagctgctaccccaagcccgggagcttctcaggtgagagaccatcggaatttgtttgtarcatttgcattatgaaagcccgctagggttttttcccccaccaaaaggtcacctacattgaacgtgatgtgctcaactaaaggagaaattctgctttattg

SEQ ID NO: 1483 - DNA, 201 bp, Homo sapiens
gaactcctgggctcaagcaaatcatccacctcgacttcccaaagcgctgggattacaggggtttgtgagccatcgcaccaagcatgaacaggatatattayatcttcaatacaccatgaacaggataaacaagataatatatcattagcaagatactatatcaaaccagtctgggtttattccagaaatgaggtttaatat

SEQ ID NO: 1484 - DNA, 201 bp, Homo sapiens; identical to SEQ ID NO: 1036

SEQ ID NO: 1485 - DNA, 201 bp, Homo sapiens; identical to SEQ ID NO: 1040

SEQ ID NO: 1486 - DNA, 201 bp, Homo sapiens
aaacctttagtgattattagatagtgggctttgaggaagcaaaatgtctaagacctaatgtatgctgattaaggtatgctggttggaattgaggcttatgyaagtcagctgataagcagaattctgtcctaaaaccatctaactataggcctaatcagactcaaacccaaagctttcattccttccctaggactgagagca

SEQ ID NO: 1487 - DNA, 201 bp, Homo sapiens; identical to SEQ ID NO: 1015

SEQ ID NO: 1488 - DNA, 201 bp, Homo sapiens; identical to SEQ ID NO: 869

SEQ ID NO: 1489 - DNA, 201 bp, Homo sapiens; identical to SEQ ID NO: 1017

SEQ ID NO: 1490 - DNA, 201 bp, Homo sapiens; identical to SEQ ID NO: 878

SEQ ID NO: 1491 - DNA, 201 bp, Homo sapiens
gtgctcgggggaggggacaccagaccttgaggaagtgaacccagggcagggctgggccgggagtggctggggtggggagacctgggtttgccggagcccgmggtggagcaggtggaatgcgacctcctcagagcctgtgactatcagggaaggagcggcccaaggaggcccgagcagtctgccaggggcagggcccctatg

SEQ ID NO: 1492 - DNA, 201 bp, Homo sapiens; identical to SEQ ID NO: 1019

SEQ ID NO: 1493 - DNA, 201 bp, Homo sapiens; identical to SEQ ID NO: 1020

SEQ ID NO: 1494 - DNA, 201 bp, Homo sapiens; identical to SEQ ID NO: 1021

SEQ ID NO: 1495 - DNA, 201 bp, Homo sapiens; identical to SEQ ID NO: 1022

SEQ ID NO: 1496 - DNA, 201 bp, Homo sapiens; identical to SEQ ID NO: 1023

SEQ ID NO: 1497 - DNA, 201 bp, Homo sapiens; identical to SEQ ID NO: 1024

SEQ ID NO: 1498 - DNA, 201 bp, Homo sapiens; identical to SEQ ID NO: 1025

SEQ ID NO: 1499 - DNA, 201 bp, Homo sapiens
ccatccatagcacagcctgtgttcgatctcctttccaaggctgagcaccttccactggacctctcggccacattttccttattcttgtacctgttgatggrcttttgcgtggcgtctacattcgagctcttgtggacactgcggctgtgaacctgggtgtgcaaatatgtgctcaagtccctgttttcagtcctttgggat

SEQ ID NO: 1500 - DNA, 201 bp, Homo sapiens; identical to SEQ ID NO: 890

SEQ ID NO: 1501 - DNA, 201 bp, Homo sapiens
gccgcggacagaggactcacttctgccacctccttggctttctgtagggcaagtttctggttcgctgcttcttcttcctcttgctcgtcctaaaaggcacrtggaatctttgttcacaaaacatgaactaggccttggggactcacttctgaccctgttgctgaccaggggcaacatttgaaatatttcgaccaatcagaa

SEQ ID NO: 1502 - DNA, 201 bp, Homo sapiens; identical to SEQ ID NO: 637

SEQ ID NO: 1503 - DNA, 201 bp, Homo sapiens; identical to SEQ ID NO: 638

SEQ ID NO: 1504 - DNA, 201 bp, Homo sapiens; identical to SEQ ID NO: 646

SEQ ID NO: 1505 - DNA, 201 bp, Homo sapiens; identical to SEQ ID NO: 647

SEQ ID NO: 1506 - DNA, 201 bp, Homo sapiens
acccctttccctggttccaggctaaacaatacccaggtaacaagcataaataaataacatcacaaagaattacacaatacccaagctggcgcaatttaaaraaaaaaaaaagatgacatgaaaattgtagagaaattttgtcaagataatgtgctaatagggtaaggagtgagtgaaaggacagaggagtcaaagataact

SEQ ID NO: 1507 - DNA, 201 bp, Homo sapiens
gaagaaaatttaaataagttgagtgccaggaattgagaacatgtgaccatgcacatctcctataaaactgttcaaagtaacacactttataaaaaatgttyagattctacatagattcatgaaattttaaatcacttaaaaatagttattcagaacatatgtgcaaaacactgtttttatatatttggaatatatcagcaa

SEQ ID NO: 1508 - DNA, 201 bp, Homo sapiens; identical to SEQ ID NO: 654

SEQ ID NO: 1509 - DNA, 201 bp, Homo sapiens
gatcagagtctgtagtttttctttcttataatgtctgtttttggcattaggataatgatgtccttatagaatgagtcaggaagtgttccctttgcttctaytttctagaagagattgtggagaattggtatcatttcttgcttaaatatttggtacatttcaccagtgaaacaatctgggcttagtgctttctttcttgga

SEQ ID NO: 1510 - DNA, 201 bp, Homo sapiens
tactttaagccttctacctacaacattacctacaagtacaggtttccctaagcccaactcacaagttaaagagttgaaacaaaattcagctttcattaatsatgagaaaaatggagcagatgggaagcactgtgagagtcatcagtgtgctagagctttctgtcagagtatttacttgagtaaacttggaaacgttgaaac

SEQ ID NO: 1511 - DNA, 201 bp, Homo sapiens; identical to SEQ ID NO: 687

SEQ ID NO: 1512 - DNA, 201 bp, Homo sapiens; identical to SEQ ID NO: 688

SEQ ID NO: 1513 - DNA, 201 bp, Homo sapiens; identical to SEQ ID NO: 689

SEQ ID NO: 1514 - DNA, 201 bp, Homo sapiens; identical to SEQ ID NO: 691

SEQ ID NO: 1515 - DNA, 201 bp, Homo sapiens; identical to SEQ ID NO: 692

SEQ ID NO: 1516 - DNA, 201 bp, Homo sapiens; identical to SEQ ID NO: 693

SEQ ID NO: 1517 - DNA, 201 bp, Homo sapiens; identical to SEQ ID NO: 694

SEQ ID NO: 1518 - DNA, 201 bp, Homo sapiens
aataaaaatgaacaggctagttatatgcacaacaacatgtcaaatcatcatgctgcaagaatgaagccagacaaaaaaagacccccctcccctcaaaaaakcctgtatgatgctatttatttgccattctagaaatgcaaattaatctatagttcccaaaagcagggcagtggttgcccgggtgagacagagaaggagaga

SEQ ID NO: 1519 - DNA, 201 bp, Homo sapiens
attaccagaaactttgtggcttaaaacaacacacatgtattatcttacagtcttggtgggttaggaacctaagtatagcttctctgggccatctacttagygtctcacaggctgcagtaaaggtgtgggccagggttgggttccatctggaggctctactggggaagaatctgcttcctatgtgcctggttgttagcagga

SEQ ID NO: 1520 - DNA, 201 bp, Homo sapiens
ttgcctcaagtcacaggtggaggcagagctgggagtggaacacaggtgagagtctggactccttaggcagtgaaaactgtgtgaaaggtaatcttttttcrgagtggaacgggagctggaagaggagtgctcagtggagggctgcaggggtgagctgatggaggtggaggtgggcagagagagaacaacacaggcaggagg

SEQ ID NO: 1521 - DNA, 201 bp, Homo sapiens
ccagaatcaaaggaaatgaaagaaggactttcatcccttctttcacctcattcccatgtagctctgctgtgttgttccatccatccccaacactaacctgrtaattcggagacaccttgccgcatattgtttcacctttaattcttgaataaactctgattcttacttataacttttcccatgtttgttgccaataaaatt

SEQ ID NO: 1522 - DNA, 201 bp, Homo sapiens
agtgaggacagccacccatcctaacagctctcttggataaagatggccccagtgagcctggcatttctggctgctggcttggcatactttcgatatactcmttacggtaaatggaaataaatgaaagaacactgagggggaaaagcatggaatagtttctactcatcctgatcgttatatcttttaaagtcaatagcatat

SEQ ID NO: 1523 - DNA, 201 bp, Homo sapiens; identical to SEQ ID NO: 1460

SEQ ID NO: 1524 - DNA, 201 bp, Homo sapiens; identical to SEQ ID NO: 1461

SEQ ID NO: 1525 - DNA, 201 bp, Homo sapiens
ctctgtgttaggattaattttgtcatttttctttacctttttatgggttttaggcagcagttgagagaccctgaggcagggctgctagccaaatactattwaaagctagaaatgcctcactgatttttatcgtagattgtttcaacctgtgttcatttcttcagcctctgactataggatttcccaggttgcagtctttgg

SEQ ID NO: 1526 - DNA, 201 bp, Homo sapiens
atagtactctattttggatttcctcaaagctggacagttttcagtgtggatagccaattttgctttgccttgcctgatcatctttggagtctgcttgtacsccagtatgtactttccactttttataacaagtagaagcctagagttgatccattccactgactttttaatcttctttgcaagcaccatcttcctgcatta

SEQ ID NO: 1527 - DNA, 201 bp, Homo sapiens
gggagaaatgtgacaggtttcatgcttcatggcatggaggaggaagggccacgtggtaatgcttgttggatgcctgttggaaataatgtaggatgaagacrgaaccataacacagtttacttccttgagcgttaggtggtatatgtattgcattcgacttccttcattgaagttgtggatgctgcagtcactgccgggatc

SEQ ID NO: 1528 - DNA, 201 bp, Homo sapiens
aacagttcgaggatacacacaatctcattaataacaatgactcataacctatttagagatttattttgataaacaattttaaaagcaaattatctttgaargtgtcaagctggttgagcattcaaaccttaaggtgaaaattattttaattagaacttaatttagttgaaatctgcagcacaaaagaagttagagagaggc

SEQ ID NO: 1529 - DNA, 201 bp, Homo sapiens
tttcatgaaaacaataccaaaaggagagatgaaaatggctacactaacatctaacaaaataagactttaagaaaaaaactgttactagagacaagggataytttagaatgatagaggtaaatttgtagcagacatccaacaacagacacccaaaatacatgaaacaaaactgacagatttcagaggacaaatagacaatgc

SEQ ID NO: 1530 - DNA, 201 bp, Homo sapiens; identical to SEQ ID NO: 1270

SEQ ID NO: 1531 - DNA, 201 bp, Homo sapiens; identical to SEQ ID NO: 1271

SEQ ID NO: 1532 - DNA, 201 bp, Homo sapiens; identical to SEQ ID NO: 1272

SEQ ID NO: 1533 - DNA, 201 bp, Homo sapiens
tacctggcacaaaggaggtgctcaagaaagatttgtgtactgaatggtgtcatttactctacagaaactctaggaggtataatgatcctcttccttacagwtaagaaactgaagtcagagtgagtcaatgatttctgcctggaaggcttgttccccaggtctccccatggctgtctcctactcttcactcaggtctcagct

SEQ ID NO: 1534 - DNA, 201 bp, Homo sapiens
gcaaaaggtcacttctagtctggtatccattatcattaggaagagtgaaaaactggtctatggggacccagggcctcctcaacccagacagagaacccacmaactcagaaaggagaccgacagtgcagggactgggttagtgccctaacaacattgtagggttttttaagggtttacaacaccatatttgttatccgaaat

SEQ ID NO: 1535 - DNA, 201 bp, Homo sapiens
gtgaggtgctgggggagagtcatttccactgccctcattacttgaaggatgcaggttgaaaattccctgttggtaattcattagcctgggaaataaataaygtggaaggcacagaggtggcatagaggaaagttgctcaccagtacccaacccccacaccggccataccaaacaggtatgtgggaacccaggtgcggggca

SEQ ID NO: 1536 - DNA, 201 bp, Homo sapiens
cctttaccagatatgccacatgcttcttctaacattttgatccaggaaattccacttcctggtgcccagccaccctccatccttaagaaaccctcagcctrtggacctccaactcaggcagtttctatccttctcttcttgggacgtggtgttccacatttgcctcctggcagaaaacctcttggccctccccctggtcca

SEQ ID NO: 1537 - DNA, 201 bp, Homo sapiens
acacccaggggtcctctagagtcttcctcctcgtctttaatttcagaaattctgtctacagatttaaggatttcggcagcaagattcagtatctcagctcyggaaaccagttgcttaatggaagcctgtgcgctgttcatgaccacccagaggttctgcaaggccacgtcggcgttctgcttcaccactgtcaggctggcc

SEQ ID NO: 1538 - DNA, 201 bp, Homo sapiens; identical to SEQ ID NO: 1501

SEQ ID NO: 1539 - DNA, 201 bp, Homo sapiens; identical to SEQ ID NO: 893

SEQ ID NO: 1540 - DNA, 201 bp, Homo sapiens; identical to SEQ ID NO: 1479

SEQ ID NO: 1541 - DNA, 201 bp, Homo sapiens; identical to SEQ ID NO: 933

SEQ ID NO: 1542 - DNA, 201 bp, Homo sapiens; identical to SEQ ID NO: 934

SEQ ID NO: 1543 - DNA, 201 bp, Homo sapiens; identical to SEQ ID NO: 935

SEQ ID NO: 1544 - DNA, 201 bp, Homo sapiens; identical to SEQ ID NO: 936

SEQ ID NO: 1545 - DNA, 201 bp, Homo sapiens; identical to SEQ ID NO: 937

SEQ ID NO: 1546 - DNA, 201 bp, Homo sapiens; identical to SEQ ID NO: 938

SEQ ID NO: 1547 - DNA, 201 bp, Homo sapiens; identical to SEQ ID NO: 939

SEQ ID NO: 1548 - DNA, 201 bp, Homo sapiens; identical to SEQ ID NO: 940

SEQ ID NO: 1549 - DNA, 201 bp, Homo sapiens; identical to SEQ ID NO: 941

SEQ ID NO: 1550 - DNA, 201 bp, Homo sapiens; identical to SEQ ID NO: 942

SEQ ID NO: 1551 - DNA, 201 bp, Homo sapiens; identical to SEQ ID NO: 943

SEQ ID NO: 1552 - DNA, 201 bp, Homo sapiens; identical to SEQ ID NO: 944

SEQ ID NO: 1553 - DNA, 201 bp, Homo sapiens; identical to SEQ ID NO: 945

SEQ ID NO: 1554 - DNA, 201 bp, Homo sapiens; identical to SEQ ID NO: 947

SEQ ID NO: 1555 - DNA, 201 bp, Homo sapiens; identical to SEQ ID NO: 948

SEQ ID NO: 1556 - DNA, 201 bp, Homo sapiens; identical to SEQ ID NO: 1222

SEQ ID NO: 1557 - DNA, 201 bp, Homo sapiens; identical to SEQ ID NO: 1304

SEQ ID NO: 1558 - DNA, 201 bp, Homo sapiens; identical to SEQ ID NO: 658

SEQ ID NO: 1559 - DNA, 201 bp, Homo sapiens; identical to SEQ ID NO: 659

SEQ ID NO: 1560 - DNA, 201 bp, Homo sapiens; identical to SEQ ID NO: 1405

SEQ ID NO: 1561 - DNA, 201 bp, Homo sapiens; identical to SEQ ID NO: 1406

SEQ ID NO: 1562 - DNA, 201 bp, Homo sapiens; identical to SEQ ID NO: 1407

SEQ ID NO: 1563 - DNA, 201 bp, Homo sapiens; identical to SEQ ID NO: 1408

SEQ ID NO: 1564 - DNA, 201 bp, Homo sapiens; identical to SEQ ID NO: 1410

SEQ ID NO: 1565 - DNA, 201 bp, Homo sapiens; identical to SEQ ID NO: 1411

SEQ ID NO: 1566 - DNA, 201 bp, Homo sapiens
aagccactaaaatgcttatttgacttttaccacctgtcctaaatttaaccaaggaaaatctgtatagactcctccttgacatttaaatttacctaataggmcattcaaggtttggcaactgaattttttccaactacctccctcccatgagtatacatatatattggttatgatctgtatgttttcccattgggtggaagg

SEQ ID NO: 1567 - DNA, 201 bp, Homo sapiens; identical to SEQ ID NO: 674

SEQ ID NO: 1568 - DNA, 201 bp, Homo sapiens; identical to SEQ ID NO: 1412

SEQ ID NO: 1569 - DNA, 201 bp, Homo sapiens; identical to SEQ ID NO: 1414

SEQ ID NO: 1570 - DNA, 201 bp, Homo sapiens; identical to SEQ ID NO: 1415

SEQ ID NO: 1571 - DNA, 201 bp, Homo sapiens; identical to SEQ ID NO: 1416

SEQ ID NO: 1572 - DNA, 201 bp, Homo sapiens
tgtgaaccatcatttaatcttcatggcagtcaaaattattatctacatttatagttggggaaaaattgaagttcagaggtgtacatttgttcaaggctgcrtaacttgaaagtggcaatcctgagtctcatcatcttctccctgtactctgtctactatcctacttaatttatctaaatgcaaggcaaggcctggtgtagt

SEQ ID NO: 1573 - DNA, 201 bp, Homo sapiens; identical to SEQ ID NO: 1417

SEQ ID NO: 1574 - DNA, 201 bp, Homo sapiens; identical to SEQ ID NO: 1419

SEQ ID NO: 1575 - DNA, 201 bp, Homo sapiens; identical to SEQ ID NO: 1420

SEQ ID NO: 1576 - DNA, 201 bp, Homo sapiens; identical to SEQ ID NO: 1421

SEQ ID NO: 1577 - DNA, 201 bp, Homo sapiens; identical to SEQ ID NO: 1306

SEQ ID NO: 1578 - DNA, 201 bp, Homo sapiens; identical to SEQ ID NO: 708

SEQ ID NO: 1579 - DNA, 201 bp, Homo sapiens; identical to SEQ ID NO: 1310

SEQ ID NO: 1580 - DNA, 201 bp, Homo sapiens; identical to SEQ ID NO: 1311

SEQ ID NO: 1581 - DNA, 201 bp, Homo sapiens; identical to SEQ ID NO: 1312

SEQ ID NO: 1582 - DNA, 201 bp, Homo sapiens; identical to SEQ ID NO: 1313

SEQ ID NO: 1583 - DNA, 201 bp, Homo sapiens
tgtgctttggaaaaaaaactttgttttggcatgaagtgcactgcttgttgatacacagtggcagctttggagcatgaaatcttgctctttatgagtatttrgcatattgtggaattagagttttgccttctctgggttttcttggctttcttcaacagcctccctacctggtccccaaaacaaaacagcaggaataaatat

SEQ ID NO: 1584 - DNA, 201 bp, Homo sapiens
ttggtctttgagacaatggtgccattaaggacccccgccaggcccaccagcaggccgagggcacagaccagcatctccatggtctcaggcacctggattakttcatggacctctggggcaccaagggaagacagagttataaggtacagagagcaggggctggccttggatgtgggaggtgttgggtattcgaaaccatga

SEQ ID NO: 1585 - DNA, 201 bp, Homo sapiens
tcctgccacctccctccactgtgcagccccaaagtgacagaggctgaggatccccagcaaagcaaactgcttctgtcatctgctttcaggcaattttgagrcaccttttcttggcttatttccactgctaagccctgacacaatataatatttcaaaagcccctaagtgctgacagaatactcaaaatcacattttacaaa

SEQ ID NO: 1586 - DNA, 201 bp, Homo sapiens; identical to SEQ ID NO: 1428

SEQ ID NO: 1587 - DNA, 201 bp, Homo sapiens
ggggcggccgtgtgccagaggcgcatgtgggtggcaccctgccagctccatgtgaccgcacgcctctctccatgtgcagtaggaaggatgtcctcgtggtgaccccttggctggctcccattgtctgggagggcacattcaacatcgacatcctcaacgagcagttcaggctccagaacaccaccattgggttaactgtgt

SEQ ID NO: 1588 - DNA, 21 bp, Homo sapiens
cacgtgtgctcacttacagat

SEQ ID NO: 1589 - DNA, 21 bp, Homo sapiens
cacgtgtgctcacttacagac

SEQ ID NO: 1590 - DNA, 19 bp, Homo sapiens
cggctcgattgtctcatac

SEQ ID NO: 1591 - DNA, 22 bp, Homo sapiens
ggctgctagccaaatactatta

SEQ ID NO: 1592 - DNA, 22 bp, Homo sapiens
ggctgctagccaaatactattt

SEQ ID NO: 1593 - DNA, 26 bp, Homo sapiens
agactgcaacctgggaaatcctatag

SEQ ID NO: 1594 - DNA, 21 bp, Homo sapiens
ggatggaatgttttccctaac

SEQ ID NO: 1595 - DNA, 21 bp, Homo sapiens
ggatggaatgttttccctaag

SEQ ID NO: 1596 - DNA, 19 bp, Homo sapiens
ccttcatgcatggaaattc

SEQ ID NO: 1597 - DNA, 27 bp, Homo sapiens
tgtttcctaagactagatacatggtat

SEQ ID NO: 1598 - DNA, 26 bp, Homo sapiens
gtttcctaagactagatacatggtac

SEQ ID NO: 1599 - DNA, 29 bp, Homo sapiens
cccaaagagttaggcataacatttagcat

SEQ ID NO: 1600 - DNA, 17 bp, Homo sapiens
ccagtgcttgccttctc

SEQ ID NO: 1601 - DNA, 17 bp, Homo sapiens
ccagtgcttgccttctt

SEQ ID NO: 1602 - DNA, 27 bp, Homo sapiens
catggatgcttgttgacacattaacct

SEQ ID NO: 1603 - DNA, 23 bp, Homo sapiens
agtttacaatctaatgcagtggt

SEQ ID NO: 1604 - DNA, 24 bp, Homo sapiens
cagtttacaatctaatgcagtgga

SEQ ID NO: 1605 - DNA, 28 bp, Homo sapiens
ctcagctaatcagttgtcaatcaagtca

SEQ ID NO: 1606 - DNA, 20 bp, Homo sapiens
aaaatgatgggaagttaggg

SEQ ID NO: 1607 - DNA, 21 bp, Homo sapiens
caaaatgatgggaagttagga

SEQ ID NO: 1608 - DNA, 25 bp, Homo sapiens
aagcttagatttgttttctcacata

SEQ ID NO: 1609 - DNA, 21 bp, Homo sapiens
ccaccttctcttcagattcac

SEQ ID NO: 1610 - DNA, 21 bp, Homo sapiens
ccaccttctcttcagattcag

SEQ ID NO: 1611 - DNA, 19 bp, Homo sapiens
ctggacgcggtatgtagac

SEQ ID NO: 1612 - DNA, 23 bp, Homo sapiens
tgagattttgaagacatctggta

SEQ ID NO: 1613 - DNA, 22 bp, Homo sapiens
gagattttgaagacatctggtg

SEQ ID NO: 1614 - DNA, 20 bp, Homo sapiens
ctgaatgcaagctgatgact

SEQ ID NO: 1615 - DNA, 23 bp, Homo sapiens
ccccaataaaaggacacagttag

SEQ ID NO: 1616 - DNA, 24 bp, Homo sapiens
gccccaataaaaggacacagttat

SEQ ID NO: 1617 - DNA, 20 bp, Homo sapiens
tgaatttgggaggcacttag

SEQ ID NO: 1618 - DNA, 28 bp, Homo sapiens
tgtcctaagattagctaatatttaacat

SEQ ID NO: 1619 - DNA, 28 bp, Homo sapiens
tgtcctaagattagctaatatttaacac

SEQ ID NO: 1620 - DNA, 19 bp, Homo sapiens
aagtgcctcccaaattcac

SEQ ID NO: 1621 - DNA, 21 bp, Homo sapiens
cccagaggtctactatctgac

SEQ ID NO: 1622 - DNA, 21 bp, Homo sapiens
cccagaggtctactatctgat

SEQ ID NO: 1623 - DNA, 26 bp, Homo sapiens
ccctcattttagcatgtagcagttca

SEQ ID NO: 1624 - DNA, 20 bp, Homo sapiens
gcaaggtgtctccgaattat

SEQ ID NO: 1625 - DNA, 20 bp, Homo sapiens
gcaaggtgtctccgaattac

SEQ ID NO: 1626 - DNA, 25 bp, Homo sapiens
ttttgggaggtgatagccagaatca

SEQ ID NO: 1627 - DNA, 18 bp, Homo sapiens
cgtgcgtgaattgaatgg

SEQ ID NO: 1628 - DNA, 19 bp, Homo sapiens
acgtgcgtgaattgaatgt

SEQ ID NO: 1629 - DNA, 23 bp, Homo sapiens
gcacggacatactcggaatcatc

SEQ ID NO: 1630 - DNA, 20 bp, Homo sapiens
gtggagaatacccactcagt

SEQ ID NO: 1631 - DNA, 19 bp, Homo sapiens
tggagaatacccactcagc

SEQ ID NO: 1632 - DNA, 25 bp, Homo sapiens
gcggggatggtattcacaacattta

SEQ ID NO: 1633 - DNA, 28 bp, Homo sapiens
cacacacatctttaaaatccattctatt

SEQ ID NO: 1634 - DNA, 28 bp, Homo sapiens
cacacacatctttaaaatccattctatc

SEQ ID NO: 1635 - DNA, 21 bp, Homo sapiens
cccaatgcctgtgctcttaac

SEQ ID NO: 1636 - DNA, 24 bp, Homo sapiens
cctttctcacctgatagaatgagt

SEQ ID NO: 1637 - DNA, 24 bp, Homo sapiens
cctttctcacctgatagaatgaga

SEQ ID NO: 1638 - DNA, 24 bp, Homo sapiens
tcattgtgtgctactcccacttca

SEQ ID NO: 1639 - DNA, 17 bp, Homo sapiens
cctggccctttcctacg

SEQ ID NO: 1640 - DNA, 17 bp, Homo sapiens
cctggccctttcctaca

SEQ ID NO: 1641 - DNA, 21 bp, Homo sapiens
cactgctggacagcaatctgt

SEQ ID NO: 1642 - DNA, 18 bp, Homo sapiens
acgaatgtgatggccaca

SEQ ID NO: 1643 - DNA, 17 bp, Homo sapiens
cgaatgtgatggccacg

SEQ ID NO: 1644 - DNA, 19 bp, Homo sapiens
ggcagcctggttgatgagt

SEQ ID NO: 1645 - DNA, 19 bp, Homo sapiens
attaagcaactggtttccg

SEQ ID NO: 1646 - DNA, 20 bp, Homo sapiens
cattaagcaactggtttcca

SEQ ID NO: 1647 - DNA, 20 bp, Homo sapiens
tcaagcagtggtgatctcag

SEQ ID NO: 1648 - DNA, 23 bp, Homo sapiens
aggacaaaatacctgtattcctt

SEQ ID NO: 1649 - DNA, 23 bp, Homo sapiens
aggacaaaatacctgtattcctc

SEQ ID NO: 1650 - DNA, 21 bp, Homo sapiens
gatgaacccacagaaaatgat

SEQ ID NO: 1651 - DNA, 19 bp, Homo sapiens
cagtccatggttccttcat

SEQ ID NO: 1652 - DNA, 19 bp, Homo sapiens
cagtccatggttccttcac

SEQ ID NO: 1653 - DNA, 19 bp, Homo sapiens
ctccacctgcatttcagag

SEQ ID NO: 1654 - DNA, 20 bp, Homo sapiens
caccttccccactctcttag

SEQ ID NO: 1655 - DNA, 19 bp, Homo sapiens
accttccccactctcttac

SEQ ID NO: 1656 - DNA, 22 bp, Homo sapiens
gccttttgcatgccttaacact

SEQ ID NO: 1657 - DNA, 19 bp, Homo sapiens
ggtgacaggggagaaaaga

SEQ ID NO: 1658 - DNA, 19 bp, Homo sapiens
ggtgacaggggagaaaagg

SEQ ID NO: 1659 - DNA, 27 bp, Homo sapiens
gtctgacctaggctaatgtctaacact

SEQ ID NO: 1660 - DNA, 20 bp, Homo sapiens
ccatgcctgatacagaagac

SEQ ID NO: 1661 - DNA, 20 bp, Homo sapiens
ccatgcctgatacagaagag

SEQ ID NO: 1662 - DNA, 19 bp, Homo sapiens
tgtgtcaggtgggatgaga

SEQ ID NO: 1663 - DNA, 18 bp, Homo sapiens
gcgtgatgatgaaatcgg

SEQ ID NO: 1664 - DNA, 18 bp, Homo sapiens
gcgtgatgatgaaatcga

SEQ ID NO: 1665 - DNA, 20 bp, Homo sapiens
agcctctcctgactgtcatc

SEQ ID NO: 1666 - DNA, 21 bp, Homo sapiens
gcagcttttgccagtaaagac

SEQ ID NO: 1667 - DNA, 21 bp, Homo sapiens
gcagcttttgccagtaaagat

SEQ ID NO: 1668 - DNA, 24 bp, Homo sapiens
ggtacgttggcttcaatggaattg

SEQ ID NO: 1669 - DNA, 18 bp, Homo sapiens
acggacactggacatacc

SEQ ID NO: 1670 - DNA, 19 bp, Homo sapiens
aacggacactggacatact

SEQ ID NO: 1671 - DNA, 24 bp, Homo sapiens
gtgacatcagctctgtgttgagat

SEQ ID NO: 1672 - DNA, 24 bp, Homo sapiens
gtgaaggtttccctttaagttact

SEQ ID NO: 1673 - DNA, 23 bp, Homo sapiens
tgaaggtttccctttaagttacc

SEQ ID NO: 1674 - DNA, 22 bp, Homo sapiens
ccttctccctcttgccttcact

SEQ ID NO: 1675 - DNA, 20 bp, Homo sapiens
gccttgtcttcaattttggt

SEQ ID NO: 1676 - DNA, 19 bp, Homo sapiens
ccttgtcttcaattttggc

SEQ ID NO: 1677 - DNA, 24 bp, Homo sapiens
aacagttaagatgttggaatacct

SEQ ID NO: 1678 - DNA, 15 bp, Homo sapiens
ggatgtggcttcccc

SEQ ID NO: 1679 - DNA, 15 bp, Homo sapiens
ggatgtggcttcccg

SEQ ID NO: 1680 - DNA, 18 bp, Homo sapiens
gactcggaccctgactga

SEQ ID NO: 1681 - DNA, 25 bp, Homo sapiens
ggtgcttagaatacatcaacaaaat

SEQ ID NO: 1682 - DNA, 25 bp, Homo sapiens
ggtgcttagaatacatcaacaaaac

SEQ ID NO: 1683 - DNA, 26 bp, Homo sapiens
ccaatcttccttacccgatttcttct

SEQ ID NO: 1684 - DNA, 25 bp, Homo sapiens
taacctgatccattatccaagatac

SEQ ID NO: 1685 - DNA, 26 bp, Homo sapiens
gtaacctgatccattatccaagatat

SEQ ID NO: 1686 - DNA, 19 bp, Homo sapiens
ggagccacccgacacttac

SEQ ID NO: 1687 - DNA, 19 bp, Homo sapiens
agcaggctactactccttc

SEQ ID NO: 1688 - DNA, 20 bp, Homo sapiens
aagcaggctactactccttt

SEQ ID NO: 1689 - DNA, 22 bp, Homo sapiens
gcagcaattcctgtttgatgtc

SEQ ID NO: 1690 - DNA, 17 bp, Homo sapiens
cgtacagacagccgagg

SEQ ID NO: 1691 - DNA, 17 bp, Homo sapiens
cgtacagacagccgagc

SEQ ID NO: 1692 - DNA, 24 bp, Homo sapiens
tcaccggacatcaaacaggaattg

SEQ ID NO: 1693 - DNA, 25 bp, Homo sapiens
tctcaacttggctatcttacaaata

SEQ ID NO: 1694 - DNA, 25 bp, Homo sapiens
tctcaacttggctatcttacaaatc

SEQ ID NO: 1695 - DNA, 21 bp, Homo sapiens
gcccatcccgagtcaaattct

SEQ ID NO: 1696 - DNA, 28 bp, Homo sapiens
cttattgagttcatcattaaagtcatct

SEQ ID NO: 1697 - DNA, 27 bp, Homo sapiens
ttattgagttcatcattaaagtcatcg

SEQ ID NO: 1698 - DNA, 25 bp, Homo sapiens
ctgtgcctccttaacagactttcag

SEQ ID NO: 1699 - DNA, 22 bp, Homo sapiens
actcaccagttgtgaagacttc

SEQ ID NO: 1700 - DNA, 23 bp, Homo sapiens
tactcaccagttgtgaagacttt

SEQ ID NO: 1701 - DNA, 21 bp, Homo sapiens
tcagggagcctagatatctca

SEQ ID NO: 1702 - DNA, 18 bp, Homo sapiens
caggctttaaggacaggc

SEQ ID NO: 1703 - DNA, 18 bp, Homo sapiens
caggctttaaggacaggg

SEQ ID NO: 1704 - DNA, 19 bp, Homo sapiens
ccagcattcgtggactcaa

SEQ ID NO: 1705 - DNA, 25 bp, Homo sapiens
catgttttgtgaacaaagattccat

SEQ ID NO: 1706 - DNA, 23 bp, Homo sapiens
tgttttgtgaacaaagattccac

SEQ ID NO: 1707 - DNA, 24 bp, Homo sapiens
ggggcacttacacagctatagaca

SEQ ID NO: 1708 - DNA, 19 bp, Homo sapiens
aggtgacagtcccaacact

SEQ ID NO: 1709 - DNA, 17 bp, Homo sapiens
gtgacagtcccaacacc

SEQ ID NO: 1710 - DNA, 23 bp, Homo sapiens
tgattctggaatgatggtaagtc

SEQ ID NO: 1711 - DNA, 24 bp, Homo sapiens
aatacttagttctcccctccataa

SEQ ID NO: 1712 - DNA, 23 bp, Homo sapiens
atacttagttctcccctccatag

SEQ ID NO: 1713 - DNA, 28 bp, Homo sapiens
ggtgaagaatgtttggctcctagaaata

SEQ ID NO: 1714 - DNA, 20 bp, Homo sapiens
agctctgagtgcactgtgtt

SEQ ID NO: 1715 - DNA, 20 bp, Homo sapiens
agctctgagtgcactgtgtc

SEQ ID NO: 1716 - DNA, 24 bp, Homo sapiens
cagagtctaggcaatttttacaac

SEQ ID NO: 1717 - DNA, 24 bp, Homo sapiens
acccaagacttagtaaacattcag

SEQ ID NO: 1718 - DNA, 24 bp, Homo sapiens
acccaagacttagtaaacattcaa

SEQ ID NO: 1719 - DNA, 27 bp, Homo sapiens
cctgtactttatctggcaatcctacct

SEQ ID NO: 1720 - DNA, 22 bp, Homo sapiens
gtggatcaagcttcgttgttat

SEQ ID NO: 1721 - DNA, 21 bp, Homo sapiens
tggatcaagcttcgttgttac

SEQ ID NO: 1722 - DNA, 26 bp, Homo sapiens
gacccaagtgtcattctcagtagaca

SEQ ID NO: 1723 - DNA, 25 bp, Homo sapiens
aaatcttgctctttatgagtatttg

SEQ ID NO: 1724 - DNA, 26 bp, Homo sapiens
gaaatcttgctctttatgagtattta

SEQ ID NO: 1725 - DNA, 24 bp, Homo sapiens
catgtctgagggtgatatttattc

SEQ ID NO: 1726 - DNA, 25 bp, Homo sapiens
catttacaatgtaacagcaaaacca

SEQ ID NO: 1727 - DNA, 23 bp, Homo sapiens
tttacaatgtaacagcaaaaccc

SEQ ID NO: 1728 - DNA, 22 bp, Homo sapiens
tccacctcttcccgtgagaaag

SEQ ID NO: 1729 - DNA, 18 bp, Homo sapiens
gctccaggacagagaacg

SEQ ID NO: 1730 - DNA, 18 bp, Homo sapiens
gctccaggacagagaaca

SEQ ID NO: 1731 - DNA, 20 bp, Homo sapiens
caccgcttacctcccttctg

SEQ ID NO: 1732 - DNA, 20 bp, Homo sapiens
ggctttcataatgcaaatgt

SEQ ID NO: 1733 - DNA, 19 bp, Homo sapiens
gctttcataatgcaaatgc

SEQ ID NO: 1734 - DNA, 19 bp, Homo sapiens
tcttgcaggtggaacagat

SEQ ID NO: 1735 - DNA, 20 bp, Homo sapiens
aaagtggagaaggctctgat

SEQ ID NO: 1736 - DNA, 20 bp, Homo sapiens
aaagtggagaaggctctgac

SEQ ID NO: 1737 - DNA, 24 bp, Homo sapiens
cacacacacacgaaacaatactac

SEQ ID NO: 1738 - DNA, 26 bp, Homo sapiens
gttggaaataatgtaggatgaagaca

SEQ ID NO: 1739 - DNA, 24 bp, Homo sapiens
tggaaataatgtaggatgaagacg

SEQ ID NO: 1740 - DNA, 17 bp, Homo sapiens
ggatcccggcagtgact

SEQ ID NO: 1741 - DNA, 22 bp, Homo sapiens
cactgagctgaaatgatccata

SEQ ID NO: 1742 - DNA, 21 bp, Homo sapiens
actgagctgaaatgatccatc

SEQ ID NO: 1743 - DNA, 23 bp, Homo sapiens
cacggggcctaggatggtatatt

SEQ ID NO: 1744 - DNA, 18 bp, Homo sapiens
cacccagtgcagattcac

SEQ ID NO: 1745 - DNA, 18 bp, Homo sapiens
cacccagtgcagattcat

SEQ ID NO: 1746 - DNA, 21 bp, Homo sapiens
cggctttgcacctctgttctt

SEQ ID NO: 1747 - DNA, 17 bp, Homo sapiens
gcaagaaggcaagtccc

SEQ ID NO: 1748 - DNA, 17 bp, Homo sapiens
gcaagaaggcaagtcca

SEQ ID NO: 1749 - DNA, 20 bp, Homo sapiens
gggtctgtgtgtgggtactg

SEQ ID NO: 1750 - DNA, 21 bp, Homo sapiens
tgtagttgaaggacagagtgg

SEQ ID NO: 1751 - DNA, 21 bp, Homo sapiens
tgtagttgaaggacagagtga

SEQ ID NO: 1752 - DNA, 19 bp, Homo sapiens
ggtgcaaagccggagagaa

SEQ ID NO: 1753 - DNA, 21 bp, Homo sapiens
ttactctaacacagggttcca

SEQ ID NO: 1754 - DNA, 19 bp, Homo sapiens
actctaacacagggttccg

SEQ ID NO: 1755 - DNA, 25 bp, Homo sapiens
cctctcatgggagatgaacagtaca

SEQ ID NO: 1756 - DNA, 18 bp, Homo sapiens
gcccagtttcaaacagga

SEQ ID NO: 1757 - DNA, 18 bp, Homo sapiens
gcccagtttcaaacaggt

SEQ ID NO: 1758 - DNA, 34 bp, Homo sapiens
gagaaaggtgtatcttttgtaatgtctgacagat

SEQ ID NO: 1759 - DNA, 19 bp, Homo sapiens
gtcctcttcaccaaggagt

SEQ ID NO: 1760 - DNA, 18 bp, Homo sapiens
tcctcttcaccaaggagc

SEQ ID NO: 1761 - DNA, 22 bp, Homo sapiens
ctcccatcagcctaggatcatg

SEQ ID NO: 1762 - DNA, 18 bp, Homo sapiens
tgaacctgagcgtgtcaa

SEQ ID NO: 1763 - DNA, 18 bp, Homo sapiens
tgaacctgagcgtgtcag

SEQ ID NO: 1764 - DNA, 18 bp, Homo sapiens
gccagtgccttcctacaa

SEQ ID NO: 1765 - DNA, 19 bp, Homo sapiens
acaaagtcacaccgaatcg

SEQ ID NO: 1766 - DNA, 20 bp, Homo sapiens
aacaaagtcacaccgaatca

SEQ ID NO: 1767 - DNA, 22 bp, Homo sapiens
cccctgcgtgatcattaaagtg

SEQ ID NO: 1768 - DNA, 23 bp, Homo sapiens
agtgggaaacacacagaaattta

SEQ ID NO: 1769 - DNA, 22 bp, Homo sapiens
gtgggaaacacacagaaatttg

SEQ ID NO: 1770 - DNA, 17 bp, Homo sapiens
gcaccattgccctccag

SEQ ID NO: 1771 - DNA, 18 bp, Homo sapiens
ggcaacctcaacacagac

SEQ ID NO: 1772 - DNA, 18 bp, Homo sapiens
ggcaacctcaacacagag

SEQ ID NO: 1773 - DNA, 26 bp, Homo sapiens
gcctgctacatttgaacttgctctta

SEQ ID NO: 1774 - DNA, 19 bp, Homo sapiens
acagcaggcattgttttct

SEQ ID NO: 1775 - DNA, 17 bp, Homo sapiens
agcaggcattgttttcc

SEQ ID NO: 1776 - DNA, 25 bp, Homo sapiens
cctataaacagcatgtgatcatatt

SEQ ID NO: 1777 - DNA, 21 bp, Homo sapiens
ggagttacacccataaaccat

SEQ ID NO: 1778 - DNA, 21 bp, Homo sapiens
ggagttacacccataaaccac

SEQ ID NO: 1779 - DNA, 23 bp, Homo sapiens
gagcaagctcagaaaatttttat

SEQ ID NO: 1780 - DNA, 20 bp, Homo sapiens
atctggtggtcattcaaatg

SEQ ID NO: 1781 - DNA, 21 bp, Homo sapiens
catctggtggtcattcaaata

SEQ ID NO: 1782 - DNA, 25 bp, Homo sapiens
tgattgtgaggttctaaaagagata

SEQ ID NO: 1783 - DNA, 20 bp, Homo sapiens
gggagagcacttgaaatgac

SEQ ID NO: 1784 - DNA, 20 bp, Homo sapiens
gggagagcacttgaaatgat

SEQ ID NO: 1785 - DNA, 21 bp, Homo sapiens
caaaggactcacaggaatgac

SEQ ID NO: 1786 - DNA, 15 bp, Homo sapiens
tcatccagccactcc

SEQ ID NO: 1787 - DNA, 17 bp, Homo sapiens
attcatccagccactct

SEQ ID NO: 1788 - DNA, 19 bp, Homo sapiens
cttcaaaggtgatgacatc

SEQ ID NO: 1789 - DNA, 28 bp, Homo sapiens
ggcttcaaagtgataaattctatattcg

SEQ ID NO: 1790 - DNA, 28 bp, Homo sapiens
ggcttcaaagtgataaattctatattca

SEQ ID NO: 1791 - DNA, 31 bp, Homo sapiens
actattcatagatgcctgtcactattcagaa

SEQ ID NO: 1792 - DNA, 22 bp, Homo sapiens
ggacacaactcattattctggg

SEQ ID NO: 1793 - DNA, 22 bp, Homo sapiens
ggacacaactcattattctggt

SEQ ID NO: 1794 - DNA, 19 bp, Homo sapiens
tggggaaggcctgatgtca

SEQ ID NO: 1795 - DNA, 23 bp, Homo sapiens
aacgaatggcatgtattttatgg

SEQ ID NO: 1796 - DNA, 24 bp, Homo sapiens
aaacgaatggcatgtattttatga

SEQ ID NO: 1797 - DNA, 22 bp, Homo sapiens
caagtgaaacatggcgtcttgt

SEQ ID NO: 1798 - DNA, 23 bp, Homo sapiens
cgatgattttgttctcatgttcg

SEQ ID NO: 1799 - DNA, 23 bp, Homo sapiens
cgatgattttgttctcatgttca

SEQ ID NO: 1800 - DNA, 25 bp, Homo sapiens
ccatcacccagggatttcaacttac

SEQ ID NO: 1801 - DNA, 20 bp, Homo sapiens
cctgttgcattctggatact

SEQ ID NO: 1802 - DNA, 20 bp, Homo sapiens
cctgttgcattctggataca

SEQ ID NO: 1803 - DNA, 22 bp, Homo sapiens
gcttctaccgcttccctctact

SEQ ID NO: 1804 - DNA, 24 bp, Homo sapiens
acctatgtaacacacccttctatt

SEQ ID NO: 1805 - DNA, 24 bp, Homo sapiens
acctatgtaacacacccttctatc

SEQ ID NO: 1806 - DNA, 33 bp, Homo sapiens
ccttgcatcttcgtatactgttaattctaaacc

SEQ ID NO: 1807 - DNA, 19 bp, Homo sapiens
accctcacagctctgaaga

SEQ ID NO: 1808 - DNA, 18 bp, Homo sapiens
ccctcacagctctgaagc

SEQ ID NO: 1809 - DNA, 18 bp, Homo sapiens
tccacacgcacaagatga

SEQ ID NO: 1810 - DNA, 16 bp, Homo sapiens
tgcacagtcccctgac

SEQ ID NO: 1811 - DNA, 17 bp, Homo sapiens
ctgcacagtcccctgat

SEQ ID NO: 1812 - DNA, 25 bp, Homo sapiens
cttcgaagaagacatgggctctaga

SEQ ID NO: 1813 - DNA, 24 bp, Homo sapiens
gggagccttaataagattaacagc

SEQ ID NO: 1814 - DNA, 24 bp, Homo sapiens
gggagccttaataagattaacagt

SEQ ID NO: 1815 - DNA, 26 bp, Homo sapiens
cctctccaacatcctctccttgttat

SEQ ID NO: 1816 - DNA, 26 bp, Homo sapiens
cctactttcacaaacatatctttgaa

SEQ ID NO: 1817 - DNA, 26 bp, Homo sapiens
cctactttcacaaacatatctttgag

SEQ ID NO: 1818 - DNA, 27 bp, Homo sapiens
cttaccatctttggttcttgccatctt

SEQ ID NO: 1819 - DNA, 20 bp, Homo sapiens
tcgtggagatactgcaagtt

SEQ ID NO: 1820 - DNA, 21 bp, Homo sapiens
gtcgtggagatactgcaagta

SEQ ID NO: 1821 - DNA, 23 bp, Homo sapiens
gctagtgccactgtttgtctatg

SEQ ID NO: 1822 - DNA, 19 bp, Homo sapiens
tctcaggcacctggattag

SEQ ID NO: 1823 - DNA, 20 bp, Homo sapiens
gtctcaggcacctggattat

SEQ ID NO: 1824 - DNA, 22 bp, Homo sapiens
ttatccaaatttcaccatctca

SEQ ID NO: 1825 - DNA, 21 bp, Homo sapiens
ggcctcactagagaaggagag

SEQ ID NO: 1826 - DNA, 21 bp, Homo sapiens
ggcctcactagagaaggagaa

SEQ ID NO: 1827 - DNA, 18 bp, Homo sapiens
ggaaggaggctggtgtgt

SEQ ID NO: 1828 - DNA, 23 bp, Homo sapiens
aaaggtttcttctgatcactgat

SEQ ID NO: 1829 - DNA, 23 bp, Homo sapiens
aaaggtttcttctgatcactgac

SEQ ID NO: 1830 - DNA, 20 bp, Homo sapiens
ccctttttgcagctgtattc

SEQ ID NO: 1831 - DNA, 26 bp, Homo sapiens
tgaagtaatactggagatcaaattac

SEQ ID NO: 1832 - DNA, 26 bp, Homo sapiens
tgaagtaatactggagatcaaattat

SEQ ID NO: 1833 - DNA, 20 bp, Homo sapiens
tgctgccccattttctaata

SEQ ID NO: 1834 - DNA, 22 bp, Homo sapiens
cagtatacctagagcatagtgg

SEQ ID NO: 1835 - DNA, 25 bp, Homo sapiens
aaccagtatacctagagcatagtga

SEQ ID NO: 1836 - DNA, 22 bp, Homo sapiens
tgttctttggtgggtaacttta

SEQ ID NO: 1837 - DNA, 18 bp, Homo sapiens
cacagggcacagataact

SEQ ID NO: 1838 - DNA, 16 bp, Homo sapiens
cagggcacagataacc

SEQ ID NO: 1839 - DNA, 19 bp, Homo sapiens
ggcctcttccctttgatta

SEQ ID NO: 1840 - DNA, 20 bp, Homo sapiens
tgtgcacaaagataggtcac

SEQ ID NO: 1841 - DNA, 21 bp, Homo sapiens
gtgtgcacaaagataggtcat

SEQ ID NO: 1842 - DNA, 25 bp, Homo sapiens
aggcttagacaaggtggtgacttac

SEQ ID NO: 1843 - DNA, 16 bp, Homo sapiens
cgggacaccatccaca

SEQ ID NO: 1844 - DNA, 16 bp, Homo sapiens
cgggacaccatccacg

SEQ ID NO: 1845 - DNA, 20 bp, Homo sapiens
tcctccatgctgggtacctc

SEQ ID NO: 1846 - DNA, 22 bp, Homo sapiens
cacatccaacgagaaattgcta

SEQ ID NO: 1847 - DNA, 21 bp, Homo sapiens
acatccaacgagaaattgctg

SEQ ID NO: 1848 - DNA, 20 bp, Homo sapiens
agggtccacgtctgacaagt

SEQ ID NO: 1849 - DNA, 21 bp, Homo sapiens
actgcttccagaagatcaagt

SEQ ID NO: 1850 - DNA, 20 bp, Homo sapiens
ctgcttccagaagatcaagc

SEQ ID NO: 1851 - DNA, 23 bp, Homo sapiens
tccagacagcagaggattactgg

SEQ ID NO: 1852 - DNA, 17 bp, Homo sapiens
cccagccacactgttga

SEQ ID NO: 1853 - DNA, 16 bp, Homo sapiens
ccagccacactgttgg

SEQ ID NO: 1854 - DNA, 20 bp, Homo sapiens
cttgcctgcatttttaacac

SEQ ID NO: 1855 - DNA, 16 bp, Homo sapiens
aggagccatgatgccc

SEQ ID NO: 1856 - DNA, 17 bp, Homo sapiens
gaggagccatgatgcct

SEQ ID NO: 1857 - DNA, 23 bp, Homo sapiens
actggtgtggtcaacgtgtatca

SEQ ID NO: 1858 - DNA, 19 bp, Homo sapiens
cctcctccatgaagctgtc

SEQ ID NO: 1859 - DNA, 19 bp, Homo sapiens
cctcctccatgaagctgtt

SEQ ID NO: 1860 - DNA, 26 bp, Homo sapiens
ccataatgcaatgtggcaagttctac

SEQ ID NO: 1861 - DNA, 18 bp, Homo sapiens
aagctccggggttattgt

SEQ ID NO: 1862 - DNA, 16 bp, Homo sapiens
gctccggggttattgc

SEQ ID NO: 1863 - DNA, 18 bp, Homo sapiens
cccgtgtgcttctgtttc

SEQ ID NO: 1864 - DNA, 17 bp, Homo sapiens
ggccatgtgctgccatc

SEQ ID NO: 1865 - DNA, 17 bp, Homo sapiens
ggccatgtgctgccatg

SEQ ID NO: 1866 - DNA, 23 bp, Homo sapiens
agtgtggctagcttgctctatat

SEQ ID NO: 1867 - DNA, 17 bp, Homo sapiens
ctggcagcgaatgttat

SEQ ID NO: 1868 - DNA, 17 bp, Homo sapiens
ctggcagcgaatgttac

SEQ ID NO: 1869 - DNA, 25 bp, Homo sapiens
cctctagaaagaaaatggactgtat

SEQ ID NO: 1870 - DNA, 33 bp, Homo sapiens
tgagttaatatttgtgtaaagtatgatgtttag

SEQ ID NO: 1871 - DNA, 33 bp, Homo sapiens
tgagttaatatttgtgtaaagtatgatgtttaa

SEQ ID NO: 1872 - DNA, 24 bp, Homo sapiens
cgaggaaggatagggtggtattgt

SEQ ID NO: 1873 - DNA, 20 bp, Homo sapiens
cacagttctctggctttttg

SEQ ID NO: 1874 - DNA, 21 bp, Homo sapiens
acacagttctctggctttttc

SEQ ID NO: 1875 - DNA, 22 bp, Homo sapiens
tggatgaacaagaaacaagtgt

SEQ ID NO: 1876 - DNA, 24 bp, Homo sapiens
tcatcacaggacatttatgagaag

SEQ ID NO: 1877 - DNA, 24 bp, Homo sapiens
tcatcacaggacatttatgagaac

SEQ ID NO: 1878 - DNA, 20 bp, Homo sapiens
ccgctgacaatcacagtgtt

SEQ ID NO: 1879 - DNA, 20 bp, Homo sapiens
aaaggtgagctccaccatac

SEQ ID NO: 1880 - DNA, 20 bp, Homo sapiens
aaaggtgagctccaccatag

SEQ ID NO: 1881 - DNA, 19 bp, Homo sapiens
ggcatcggcacatagtaga

SEQ ID NO: 1882 - DNA, 26 bp, Homo sapiens
cctccactagaagacactactacttt

SEQ ID NO: 1883 - DNA, 26 bp, Homo sapiens
cctccactagaagacactactacttc

SEQ ID NO: 1884 - DNA, 24 bp, Homo sapiens
ttcttcacagcttccattagtaag

SEQ ID NO: 1885 - DNA, 18 bp, Homo sapiens
cttcttcccttcgctctg

SEQ ID NO: 1886 - DNA, 19 bp, Homo sapiens
acttcttcccttcgctctt

SEQ ID NO: 1887 - DNA, 20 bp, Homo sapiens
caacaggcaggtttcttctc

SEQ ID NO: 1888 - DNA, 18 bp, Homo sapiens
ctgaagcgcaaccataac

SEQ ID NO: 1889 - DNA, 18 bp, Homo sapiens
ctgaagcgcaaccataat

SEQ ID NO: 1890 - DNA, 22 bp, Homo sapiens
tcccatagaaaaatgcactaag

SEQ ID NO: 1891 - DNA, 16 bp, Homo sapiens
ccacccaatgccaagt

SEQ ID NO: 1892 - DNA, 15 bp, Homo sapiens
cacccaatgccaagc

SEQ ID NO: 1893 - DNA, 16 bp, Homo sapiens
gcacatgcgcaatagc

SEQ ID NO: 1894 - DNA, 25 bp, Homo sapiens
gcattcacagtgttctcattataat

SEQ ID NO: 1895 - DNA, 25 bp, Homo sapiens
gcattcacagtgttctcattataag

SEQ ID NO: 1896 - DNA, 21 bp, Homo sapiens
ggcttctgcagagctgtaaga

SEQ ID NO: 1897 - DNA, 19 bp, Homo sapiens
ctgcagagctgtaagagtg

SEQ ID NO: 1898 - DNA, 20 bp, Homo sapiens
tctgcagagctgtaagagtt

SEQ ID NO: 1899 - DNA, 26 bp, Homo sapiens
aagaaatagggagagaggggagtagt

SEQ ID NO: 1900 - DNA, 20 bp, Homo sapiens
tctgctccatttttctcatg

SEQ ID NO: 1901 - DNA, 21 bp, Homo sapiens
atctgctccatttttctcatc

SEQ ID NO: 1902 - DNA, 26 bp, Homo sapiens
tttaagccttctacctacaacattac

SEQ ID NO: 1903 - DNA, 16 bp, Homo sapiens
agctgaggagagtccg

SEQ ID NO: 1904 - DNA, 18 bp, Homo sapiens
gaagctgaggagagtcct

SEQ ID NO: 1905 - DNA, 17 bp, Homo sapiens
acgtccgagacacagtc

SEQ ID NO: 1906 - DNA, 30 bp, Homo sapiens
aataattgtaactctagaacaaaagtattc

SEQ ID NO: 1907 - DNA, 30 bp, Homo sapiens
aataattgtaactctagaacaaaagtattt

SEQ ID NO: 1908 - DNA, 22 bp, Homo sapiens
agaaacttttctttgctgatga

SEQ ID NO: 1909 - DNA, 17 bp, Homo sapiens
gttccagttccgatagc

SEQ ID NO: 1910 - DNA, 18 bp, Homo sapiens
ggttccagttccgatagt

SEQ ID NO: 1911 - DNA, 19 bp, Homo sapiens
gggttgggcttaatgactt

SEQ ID NO: 1912 - DNA, 21 bp, Homo sapiens
cacaccagcaatgatgaaact

SEQ ID NO: 1913 - DNA, 19 bp, Homo sapiens
caccagcaatgatgaaacc

SEQ ID NO: 1914 - DNA, 21 bp, Homo sapiens
gggctaactctttgcatgttc

SEQ ID NO: 1915 - DNA, 23 bp, Homo sapiens
gtcacttatttgaatcccattgc

SEQ ID NO: 1916 - DNA, 24 bp, Homo sapiens
agtcacttatttgaatcccattgt

SEQ ID NO: 1917 - DNA, 24 bp, Homo sapiens
gcaaactaagggaccacctgaatc

SEQ ID NO: 1918 - DNA, 20 bp, Homo sapiens
aagactttttccaggaatgc

SEQ ID NO: 1919 - DNA, 21 bp, Homo sapiens
gaagactttttccaggaatgt

SEQ ID NO: 1920 - DNA, 24 bp, Homo sapiens
ttcttaaagggtcatgaaacttac

SEQ ID NO: 1921 - DNA, 16 bp, Homo sapiens
cggcagccaatgacat

SEQ ID NO: 1922 - DNA, 16 bp, Homo sapiens
cggcagccaatgacac

SEQ ID NO: 1923 - DNA, 20 bp, Homo sapiens
aacctccagctttcagacac

SEQ ID NO: 1924 - DNA, 20 bp, Homo sapiens
cagtttatgcctgcaacaat

SEQ ID NO: 1925 - DNA, 20 bp, Homo sapiens
cagtttatgcctgcaacaac

SEQ ID NO: 1926 - DNA, 19 bp, Homo sapiens
ttggctctggagaatgaga

SEQ ID NO: 1927 - DNA, 21 bp, Homo sapiens
gcccataaggagacagaaaag

SEQ ID NO: 1928 - DNA, 21 bp, Homo sapiens
gcccataaggagacagaaaat

SEQ ID NO: 1929 - DNA, 27 bp, Homo sapiens
aatgcagtaatttgtgagttttactac

SEQ ID NO: 1930 - DNA, 19 bp, Homo sapiens
caccatgtgtgtgttccat

SEQ ID NO: 1931 - DNA, 19 bp, Homo sapiens
caccatgtgtgtgttccac

SEQ ID NO: 1932 - DNA, 21 bp, Homo sapiens
aatccagagcttcagattctg

SEQ ID NO: 1933 - DNA, 20 bp, Homo sapiens
agaatttggccacaaagagt

SEQ ID NO: 1934 - DNA, 18 bp, Homo sapiens
aatttggccacaaagagc

SEQ ID NO: 1935 - DNA, 16 bp, Homo sapiens
ccccgccagacatctt

SEQ ID NO: 1936 - DNA, 22 bp, Homo sapiens
gagtgagaattctgtcaagagg

SEQ ID NO: 1937 - DNA, 23 bp, Homo sapiens
agagtgagaattctgtcaagaga

SEQ ID NO: 1938 - DNA, 19 bp, Homo sapiens
ggtgaagcccacgatatct

SEQ ID NO: 1939 - DNA, 22 bp, Homo sapiens
aaaagagggagtaaacaactgt

SEQ ID NO: 1940 - DNA, 21 bp, Homo sapiens
aaagagggagtaaacaactgc

SEQ ID NO: 1941 - DNA, 26 bp, Homo sapiens
tcccttcttggacttcacattgatga

SEQ ID NO: 1942 - DNA, 18 bp, Homo sapiens
ctggaaagatggaggcat

SEQ ID NO: 1943 - DNA, 17 bp, Homo sapiens
tggaaagatggaggcag

SEQ ID NO: 1944 - DNA, 19 bp, Homo sapiens
gagggcaccaatcattaca

SEQ ID NO: 1945 - DNA, 18 bp, Homo sapiens
aagcgattcctcagcagt

SEQ ID NO: 1946 - DNA, 16 bp, Homo sapiens
gcgattcctcagcagc

SEQ ID NO: 1947 - DNA, 20 bp, Homo sapiens
tgtgctgatcagcaaagtgt

SEQ ID NO: 1948 - DNA, 23 bp, Homo sapiens
acaacataaaactgacttggaag

SEQ ID NO: 1949 - DNA, 23 bp, Homo sapiens
acaacataaaactgacttggaaa

SEQ ID NO: 1950 - DNA, 17 bp, Homo sapiens
aatgggctggctaccat

SEQ ID NO: 1951 - DNA, 25 bp, Homo sapiens
tgttggtaaaagtatgtaggatctt

SEQ ID NO: 1952 - DNA, 25 bp, Homo sapiens
tgttggtaaaagtatgtaggatctg

SEQ ID NO: 1953 - DNA, 27 bp, Homo sapiens
ccatttatagaatgagtgagatgatat

SEQ ID NO: 1954 - DNA, 19 bp, Homo sapiens
ccaggaatggagaccatct

SEQ ID NO: 1955 - DNA, 18 bp, Homo sapiens
caggaatggagaccatcc

SEQ ID NO: 1956 - DNA, 22 bp, Homo sapiens
agtaaagggcaggaacatagag

SEQ ID NO: 1957 - DNA, 20 bp, Homo sapiens
tctgtcttccacaaccaaag

SEQ ID NO: 1958 - DNA, 20 bp, Homo sapiens
tctgtcttccacaaccaaaa

SEQ ID NO: 1959 - DNA, 24 bp, Homo sapiens
tgtggttgtaagaatcaatcctaa

SEQ ID NO: 1960 - DNA, 20 bp, Homo sapiens
tatctccttcaaaggatgca

SEQ ID NO: 1961 - DNA, 22 bp, Homo sapiens
actatctccttcaaaggatgct

SEQ ID NO: 1962 - DNA, 22 bp, Homo sapiens
gcacagagcttaggagacatag

SEQ ID NO: 1963 - DNA, 26 bp, Homo sapiens
caacctaatttaagccatcattaacg

SEQ ID NO: 1964 - DNA, 26 bp, Homo sapiens
caacctaatttaagccatcattaaca

SEQ ID NO: 1965 - DNA, 30 bp, Homo sapiens
gcaacaggctgatgttcatatatttctctt

SEQ ID NO: 1966 - DNA, 21 bp, Homo sapiens
caactcaaacaggacactgag

SEQ ID NO: 1967 - DNA, 21 bp, Homo sapiens
caactcaaacaggacactgaa

SEQ ID NO: 1968 - DNA, 25 bp, Homo sapiens
atacgacgatcatgagccatgtcta

SEQ ID NO: 1969 - DNA, 17 bp, Homo sapiens
tcagctggcgaagttga

SEQ ID NO: 1970 - DNA, 16 bp, Homo sapiens
cagctggcgaagttgg

SEQ ID NO: 1971 - DNA, 24 bp, Homo sapiens
tgccatgtagccatcttgagtgta

SEQ ID NO: 1972 - DNA, 23 bp, Homo sapiens
gctgttaattcaggaggtaaagc

SEQ ID NO: 1973 - DNA, 23 bp, Homo sapiens
gctgttaattcaggaggtaaagg

SEQ ID NO: 1974 - DNA, 26 bp, Homo sapiens
cttggaggccagaacaataggtagaa

SEQ ID NO: 1975 - DNA, 21 bp, Homo sapiens
ccagtcatctctgcagaaaaa

SEQ ID NO: 1976 - DNA, 21 bp, Homo sapiens
ccagtcatctctgcagaaaag

SEQ ID NO: 1977 - DNA, 20 bp, Homo sapiens
ggatcacacttcaccatctg

SEQ ID NO: 1978 - DNA, 26 bp, Homo sapiens
gggataaatattacaaacccatgcta

SEQ ID NO: 1979 - DNA, 25 bp, Homo sapiens
ggataaatattacaaacccatgctg

SEQ ID NO: 1980 - DNA, 27 bp, Homo sapiens
tgacccaaatccttttctcaccatact

SEQ ID NO: 1981 - DNA, 23 bp, Homo sapiens
cacagaagatacagcaaatggaa

SEQ ID NO: 1982 - DNA, 22 bp, Homo sapiens
acagaagatacagcaaatggag

SEQ ID NO: 1983 - DNA, 27 bp, Homo sapiens
aggtgttcctgatgtcatttcacagta

SEQ ID NO: 1984 - DNA, 19 bp, Homo sapiens
aaacagtaacaggctcagc

SEQ ID NO: 1985 - DNA, 20 bp, Homo sapiens
caaacagtaacaggctcagt

SEQ ID NO: 1986 - DNA, 25 bp, Homo sapiens
catctcaagggtagggagaagtcaa

SEQ ID NO: 1987 - DNA, 18 bp, Homo sapiens
caggcctcggaaaatgaa

SEQ ID NO: 1988 - DNA, 18 bp, Homo sapiens
caggcctcggaaaatgag

SEQ ID NO: 1989 - DNA, 27 bp, Homo sapiens
tttgaaacgcccgacattcttctattc

SEQ ID NO: 1990 - DNA, 18 bp, Homo sapiens
cgcacttttagtggctgg

SEQ ID NO: 1991 - DNA, 18 bp, Homo sapiens
cgcacttttagtggctga

SEQ ID NO: 1992 - DNA, 24 bp, Homo sapiens
gggcagtacaggacatacattctc

SEQ ID NO: 1993 - DNA, 22 bp, Homo sapiens
agctaatactcctgtcctgaaa

SEQ ID NO: 1994 - DNA, 23 bp, Homo sapiens
aagctaatactcctgtcctgaac

SEQ ID NO: 1995 - DNA, 21 bp, Homo sapiens
aagttctttgctccgacttct

SEQ ID NO: 1996 - DNA, 15 bp, Homo sapiens
gcaggggcattggtg

SEQ ID NO: 1997 - DNA, 16 bp, Homo sapiens
ggcaggggcattggta

SEQ ID NO: 1998 - DNA, 25 bp, Homo sapiens
cctttacccaccttcctctgtatct

SEQ ID NO: 1999 - DNA, 26 bp, Homo sapiens
cttacgattagttccaacatgaatac

SEQ ID NO: 2000 - DNA, 26 bp, Homo sapiens
cttacgattagttccaacatgaatat

SEQ ID NO: 2001 - DNA, 28 bp, Homo sapiens
tcttccaccatcccaaagttactaaaca

SEQ ID NO: 2002 - DNA, 19 bp, Homo sapiens
cccactaagcacaggaaag

SEQ ID NO: 2003 - DNA, 19 bp, Homo sapiens
cccactaagcacaggaaaa

SEQ ID NO: 2004 - DNA, 24 bp, Homo sapiens
cagttgaagtggacaggcattact

SEQ ID NO: 2005 - DNA, 16 bp, Homo sapiens
tggtctgtgccctcag

SEQ ID NO: 2006 - DNA, 17 bp, Homo sapiens
atggtctgtgccctcaa

SEQ ID NO: 2007 - DNA, 26 bp, Homo sapiens
cctattgctcccactcttcctactac

SEQ ID NO: 2008 - DNA, 23 bp, Homo sapiens
tgccttggatatgctttaaagat

SEQ ID NO: 2009 - DNA, 23 bp, Homo sapiens
tgccttggatatgctttaaagag

SEQ ID NO: 2010 - DNA, 26 bp, Homo sapiens
aaacatttgccacaaggcaagttttg

SEQ ID NO: 2011 - DNA, 24 bp, Homo sapiens
ctagcactggaacgataataaaga

SEQ ID NO: 2012 - DNA, 22 bp, Homo sapiens
agcactggaacgataataaagc

SEQ ID NO: 2013 - DNA, 29 bp, Homo sapiens
ccttgcaaataaccattaagacccttaca

SEQ ID NO: 2014 - DNA, 30 bp, Homo sapiens
gactttacgactaattaggtataaaggtta

SEQ ID NO: 2015 - DNA, 28 bp, Homo sapiens
ctttacgactaattaggtataaaggttc

SEQ ID NO: 2016 - DNA, 29 bp, Homo sapiens
gttgctaaatctcccatttctgctcttat

SEQ ID NO: 2017 - DNA, 24 bp, Homo sapiens
gcaggtcagataacttctttatga

SEQ ID NO: 2018 - DNA, 24 bp, Homo sapiens
gcaggtcagataacttctttatgg

SEQ ID NO: 2019 - DNA, 24 bp, Homo sapiens
ctgttccattctccccagagacta

SEQ ID NO: 2020 - DNA, 19 bp, Homo sapiens
caccgtattcagctgagac

SEQ ID NO: 2021 - DNA, 20 bp, Homo sapiens
acaccgtattcagctgagat

SEQ ID NO: 2022 - DNA, 21 bp, Homo sapiens
gtctggggtgaatccagtcat

SEQ ID NO: 2023 - DNA, 20 bp, Homo sapiens
gtacctcttggtctctctcc

SEQ ID NO: 2024 - DNA, 20 bp, Homo sapiens
gtacctcttggtctctctcg

SEQ ID NO: 2025 - DNA, 25 bp, Homo sapiens
ggagcatgttgtgtttctgattgta

SEQ ID NO: 2026 - DNA, 25 bp, Homo sapiens
ccagttttgcacatttaaagatacg

SEQ ID NO: 2027 - DNA, 25 bp, Homo sapiens
ccagttttgcacatttaaagatacc

SEQ ID NO: 2028 - DNA, 19 bp, Homo sapiens
ggctctctgccccatgaac

SEQ ID NO: 2029 - DNA, 18 bp, Homo sapiens
cctccatgtcatcctacg

SEQ ID NO: 2030 - DNA, 18 bp, Homo sapiens
cctccatgtcatcctaca

SEQ ID NO: 2031 - DNA, 20 bp, Homo sapiens
tgccgagtctgagaagattc

SEQ ID NO: 2032 - DNA, 20 bp, Homo sapiens
ttagtgtaatgggcaagacg

SEQ ID NO: 2033 - DNA, 22 bp, Homo sapiens
atttagtgtaatgggcaagaca

SEQ ID NO: 2034 - DNA, 26 bp, Homo sapiens
cacagcctgtatcggtttgaactaac

SEQ ID NO: 2035 - DNA, 17 bp, Homo sapiens
ctcctcctgtctccgtt

SEQ ID NO: 2036 - DNA, 17 bp, Homo sapiens
ctcctcctgtctccgtg

SEQ ID NO: 2037 - DNA, 23 bp, Homo sapiens
gattttggagctgggtcactcac

SEQ ID NO: 2038 - DNA, 15 bp, Homo sapiens
gggatgtgcaacccg

SEQ ID NO: 2039 - DNA, 16 bp, Homo sapiens
tgggatgtgcaaccct

SEQ ID NO: 2040 - DNA, 24 bp, Homo sapiens
gttccaggacaaccctcagatact

SEQ ID NO: 2041 - DNA, 20 bp, Homo sapiens
ggcatctctcaatccctacg

SEQ ID NO: 2042 - DNA, 20 bp, Homo sapiens
ggcatctctcaatccctaca

SEQ ID NO: 2043 - DNA, 22 bp, Homo sapiens
gcatctgagtttgcctgacaca

SEQ ID NO: 2044 - DNA, 23 bp, Homo sapiens
tgtttggacaatgacttggaaat

SEQ ID NO: 2045 - DNA, 22 bp, Homo sapiens
gtttggacaatgacttggaaac

SEQ ID NO: 2046 - DNA, 21 bp, Homo sapiens
cctgaacccaggaggtcatct

SEQ ID NO: 2047 - DNA, 21 bp, Homo sapiens
aagaggtcaagccaatgaaat

SEQ ID NO: 2048 - DNA, 20 bp, Homo sapiens
agaggtcaagccaatgaaac

SEQ ID NO: 2049 - DNA, 23 bp, Homo sapiens
ggggcagatgtgaattagtgtct

SEQ ID NO: 2050 - DNA, 15 bp, Homo sapiens
ggctgccagggacat

SEQ ID NO: 2051 - DNA, 15 bp, Homo sapiens
ggctgccagggacac

SEQ ID NO: 2052 - DNA, 21 bp, Homo sapiens
ctgtggtaccccttggaggag

SEQ ID NO: 2053 - DNA, 26 bp, Homo sapiens
ggcatacaaattcaaaatactgtata

SEQ ID NO: 2054 - DNA, 26 bp, Homo sapiens
ggcatacaaattcaaaatactgtatc

SEQ ID NO: 2055 - DNA, 23 bp, Homo sapiens
ggtgtcttggtgatctcacataa

SEQ ID NO: 2056 - DNA, 19 bp, Homo sapiens
gccatgttgactcgagaat

SEQ ID NO: 2057 - DNA, 19 bp, Homo sapiens
gccatgttgactcgagaac

SEQ ID NO: 2058 - DNA, 20 bp, Homo sapiens
tgtgagggaggctgtctact

SEQ ID NO: 2059 - DNA, 26 bp, Homo sapiens
ctacctgtgtctgtatttctttaaat

SEQ ID NO: 2060 - DNA, 26 bp, Homo sapiens
ctacctgtgtctgtatttctttaaac

SEQ ID NO: 2061 - DNA, 23 bp, Homo sapiens
atctgccttcttagtgaattgat

SEQ ID NO: 2062 - DNA, 23 bp, Homo sapiens
ggaggatactgaagtagcaaact

SEQ ID NO: 2063 - DNA, 22 bp, Homo sapiens
gaggatactgaagtagcaaacg

SEQ ID NO: 2064 - DNA, 23 bp, Homo sapiens
gagttcggtatgcatcctcacat

SEQ ID NO: 2065 - DNA, 21 bp, Homo sapiens
acttgagttacaccagaccta

SEQ ID NO: 2066 - DNA, 20 bp, Homo sapiens
cttgagttacaccagacctg

SEQ ID NO: 2067 - DNA, 24 bp, Homo sapiens
tcagccgttcagacaatattgtta

SEQ ID NO: 2068 - DNA, 15 bp, Homo sapiens
caggccaggtcaaca

SEQ ID NO: 2069 - DNA, 15 bp, Homo sapiens
caggccaggtcaacg

SEQ ID NO: 2070 - DNA, 20 bp, Homo sapiens
caggaccctccctcagagac

SEQ ID NO: 2071 - DNA, 23 bp, Homo sapiens
gaggttccatggagtaaacaata

SEQ ID NO: 2072 - DNA, 23 bp, Homo sapiens
gaggttccatggagtaaacaatt

SEQ ID NO: 2073 - DNA, 27 bp, Homo sapiens
cattgccttttatgaggctcaaacata

SEQ ID NO: 2074 - DNA, 17 bp, Homo sapiens
gcactagaaacctgccg

SEQ ID NO: 2075 - DNA, 18 bp, Homo sapiens
tgcactagaaacctgcca

SEQ ID NO: 2076 - DNA, 26 bp, Homo sapiens
catccaagggtatactgtgccattat

SEQ ID NO: 2077 - DNA, 22 bp, Homo sapiens
cttacttaggtcactttcagca

SEQ ID NO: 2078 - DNA, 22 bp, Homo sapiens
cttacttaggtcactttcagcg

SEQ ID NO: 2079 - DNA, 25 bp, Homo sapiens
gtctggaaacaactcggaggatact

SEQ ID NO: 2080 - DNA, 25 bp, Homo sapiens
atattggcgagttatctaatgtctt

SEQ ID NO: 2081 - DNA, 23 bp, Homo sapiens
attggcgagttatctaatgtctc

SEQ ID NO: 2082 - DNA, 25 bp, Homo sapiens
ctcacaattgcatagtgccctctta

SEQ ID NO: 2083 - DNA, 19 bp, Homo sapiens
tgctagggactaaccttgg

SEQ ID NO: 2084 - DNA, 20 bp, Homo sapiens
ctgctagggactaaccttga

SEQ ID NO: 2085 - DNA, 29 bp, Homo sapiens
caacttgtattcctctgcaggatttactg

SEQ ID NO: 2086 - DNA, 18 bp, Homo sapiens
cccaactgacccaaaggt

SEQ ID NO: 2087 - DNA, 17 bp, Homo sapiens
ccaactgacccaaaggc

SEQ ID NO: 2088 - DNA, 34 bp, Homo sapiens
ccagaatgcaacaggtaaatataacatcaaatcc

SEQ ID NO: 2089 - DNA, 19 bp, Homo sapiens
caggcctgaagtctaggtc

SEQ ID NO: 2090 - DNA, 19 bp, Homo sapiens
caggcctgaagtctaggtt

SEQ ID NO: 2091 - DNA, 19 bp, Homo sapiens
ccccagcaccaggattcag

SEQ ID NO: 2092 - DNA, 30 bp, Homo sapiens
gactacactactatgcaatatatctatgta

SEQ ID NO: 2093 - DNA, 29 bp, Homo sapiens
actacactactatgcaatatatctatgtg

SEQ ID NO: 2094 - DNA, 25 bp, Homo sapiens
accttcccctgatttcctgacatat

SEQ ID NO: 2095 - DNA, 23 bp, Homo sapiens
gcctgaattctgagaagacatag

SEQ ID NO: 2096 - DNA, 23 bp, Homo sapiens
gcctgaattctgagaagacataa

SEQ ID NO: 2097 - DNA, 27 bp, Homo sapiens
aggccaatcttaggttctacaaacagt

SEQ ID NO: 2098 - DNA, 23 bp, Homo sapiens
ccatttatgcaaaagcagaatca

SEQ ID NO: 2099 - DNA, 23 bp, Homo sapiens
ccatttatgcaaaagcagaatcc

SEQ ID NO: 2100 - DNA, 25 bp, Homo sapiens
gacatttggcttggttccaagtctt

SEQ ID NO: 2101 - DNA, 24 bp, Homo sapiens
agtgttgtatttgtatgtgtgtct

SEQ ID NO: 2102 - DNA, 23 bp, Homo sapiens
gtgttgtatttgtatgtgtgtcg

SEQ ID NO: 2103 - DNA, 23 bp, Homo sapiens
ggtttatgagcagcaggcataca

SEQ ID NO: 2104 - DNA, 20 bp, Homo sapiens
cacagctcttctactccacc

SEQ ID NO: 2105 - DNA, 21 bp, Homo sapiens
ccacagctcttctactccact

SEQ ID NO: 2106 - DNA, 18 bp, Homo sapiens
gaggctcttggggtactt

SEQ ID NO: 2107 - DNA, 15 bp, Homo sapiens
ggcctcctgctccaa

SEQ ID NO: 2108 - DNA, 15 bp, Homo sapiens
ggcctcctgctccag

SEQ ID NO: 2109 - DNA, 17 bp, Homo sapiens
tcccagccccacaagag

SEQ ID NO: 2110 - DNA, 28 bp, Homo sapiens
ggtaatcatttaacacatttcatgttcc

SEQ ID NO: 2111 - DNA, 28 bp, Homo sapiens
ggtaatcatttaacacatttcatgttct

SEQ ID NO: 2112 - DNA, 25 bp, Homo sapiens
gcatctcaggaaattcagcacaact

SEQ ID NO: 2113 - DNA, 17 bp, Homo sapiens
tgtgccagtccttgtgt

SEQ ID NO: 2114 - DNA, 16 bp, Homo sapiens
gtgccagtccttgtgc

SEQ ID NO: 2115 - DNA, 21 bp, Homo sapiens
ctgccactctcgcatgtcatt

SEQ ID NO: 2116 - DNA, 18 bp, Homo sapiens
gctctggacctggaagtg

SEQ ID NO: 2117 - DNA, 20 bp, Homo sapiens
gagctctggacctggaagta

SEQ ID NO: 2118 - DNA, 18 bp, Homo sapiens
ccagagcctgggctatct

SEQ ID NO: 2119 - DNA, 23 bp, Homo sapiens
agtgtgctcatgatgaaagaaaa

SEQ ID NO: 2120 - DNA, 23 bp, Homo sapiens
agtgtgctcatgatgaaagaaat

SEQ ID NO: 2121 - DNA, 24 bp, Homo sapiens
ttgtccctcatccttgtcatcact

SEQ ID NO: 2122 - DNA, 26 bp, Homo sapiens
gtgtgatatgactttcatttagaacg

SEQ ID NO: 2123 - DNA, 27 bp, Homo sapiens
cgtgtgatatgactttcatttagaaca

SEQ ID NO: 2124 - DNA, 26 bp, Homo sapiens
catggcttcctgtaatggaaacacat

SEQ ID NO: 2125 - DNA, 22 bp, Homo sapiens
tgcatccacataaaatgctact

SEQ ID NO: 2126 - DNA, 22 bp, Homo sapiens
tgcatccacataaaatgctaca

SEQ ID NO: 2127 - DNA, 23 bp, Homo sapiens
catctcccagctgagtcaacaac

SEQ ID NO: 2128 - DNA, 27 bp, Homo sapiens
gttcaagttaaatgatagggtaatacc

SEQ ID NO: 2129 - DNA, 27 bp, Homo sapiens
gttcaagttaaatgatagggtaatact

SEQ ID NO: 2130 - DNA, 34 bp, Homo sapiens
gaacgattagaatgctgaactttcacatttagac

SEQ ID NO: 2131 - DNA, 27 bp, Homo sapiens
gtactttctgttcaacatcttttaagt

SEQ ID NO: 2132 - DNA, 27 bp, Homo sapiens
gtactttctgttcaacatcttttaaga

SEQ ID NO: 2133 - DNA, 29 bp, Homo sapiens
cagtgttaatgagtgtagacctcagagat

SEQ ID NO: 2134 - DNA, 23 bp, Homo sapiens
ccagacctcatattttccttcag

SEQ ID NO: 2135 - DNA, 23 bp, Homo sapiens
ccagacctcatattttccttcac

SEQ ID NO: 2136 - DNA, 17 bp, Homo sapiens
cggcctggctgctaaca

SEQ ID NO: 2137 - DNA, 17 bp, Homo sapiens
ctggctccttctccgtc

SEQ ID NO: 2138 - DNA, 17 bp, Homo sapiens
ctggctccttctccgtt

SEQ ID NO: 2139 - DNA, 20 bp, Homo sapiens
gggactgaggctccaactac

SEQ ID NO: 2140 - DNA, 21 bp, Homo sapiens
gccatctacaggcttactcat

SEQ ID NO: 2141 - DNA, 21 bp, Homo sapiens
gccatctacaggcttactcac

SEQ ID NO: 2142 - DNA, 30 bp, Homo sapiens
gctgctataataaagttgctccttcaagta

SEQ ID NO: 2143 - DNA, 24 bp, Homo sapiens
cataatttgcttttgaccacaaca

SEQ ID NO: 2144 - DNA, 20 bp, Homo sapiens
atttgcttttgaccacaacg

SEQ ID NO: 2145 - DNA, 30 bp, Homo sapiens
cactcaagtactcaagcctcttttataagc

SEQ ID NO: 2146 - DNA, 20 bp, Homo sapiens
ccagcctcaggttaaggatc

SEQ ID NO: 2147 - DNA, 20 bp, Homo sapiens
ccagcctcaggttaaggatt

SEQ ID NO: 2148 - DNA, 21 bp, Homo sapiens
aactcccgaccccaggtaatc

SEQ ID NO: 2149 - DNA, 25 bp, Homo sapiens
tccattgatactgcattaaaccata

SEQ ID NO: 2150 - DNA, 24 bp, Homo sapiens
ccattgatactgcattaaaccatg

SEQ ID NO: 2151 - DNA, 21 bp, Homo sapiens
tctttgtgttgcctgcctatg

SEQ ID NO: 2152 - DNA, 27 bp, Homo sapiens
gcatcctgtcaaatactctcattatag

SEQ ID NO: 2153 - DNA, 27 bp, Homo sapiens
gcatcctgtcaaatactctcattatac

SEQ ID NO: 2154 - DNA, 25 bp, Homo sapiens
cacctgagacagaattgggtctaac

SEQ ID NO: 2155 - DNA, 25 bp, Homo sapiens
gcaaactaaagcaacaataagacac

SEQ ID NO: 2156 - DNA, 25 bp, Homo sapiens
gcaaactaaagcaacaataagacat

SEQ ID NO: 2157 - DNA, 25 bp, Homo sapiens
ctcctgttgcttcacatcctctcta

SEQ ID NO: 2158 - DNA, 27 bp, Homo sapiens
cctttgtactttaaatcatctctaggt

SEQ ID NO: 2159 - DNA, 27 bp, Homo sapiens
cctttgtactttaaatcatctctagga

SEQ ID NO: 2160 - DNA, 28 bp, Homo sapiens
atggttgcatctctactgaacatgtaca

SEQ ID NO: 2161 - DNA, 25 bp, Homo sapiens
agaaaattaagccaggagaagttaa

SEQ ID NO: 2162 - DNA, 25 bp, Homo sapiens
agaaaattaagccaggagaagttag

SEQ ID NO: 2163 - DNA, 22 bp, Homo sapiens
ccctccccatttgttgtcatga

SEQ ID NO: 2164 - DNA, 21 bp, Homo sapiens
tgctttcaggcaattttgaga

SEQ ID NO: 2165 - DNA, 20 bp, Homo sapiens
gctttcaggcaattttgagg

SEQ ID NO: 2166 - DNA, 24 bp, Homo sapiens
gaggcctctgtctttggttttgta

SEQ ID NO: 2167 - DNA, 20 bp, Homo sapiens
ggggtgaagaagaaacctcc

SEQ ID NO: 2168 - DNA, 20 bp, Homo sapiens
ggggtgaagaagaaacctct

SEQ ID NO: 2169 - DNA, 24 bp, Homo sapiens
gacagtgaatgggtcagcacatac

SEQ ID NO: 2170 - DNA, 25 bp, Homo sapiens
gatgaagtagttcattttgaatggc

SEQ ID NO: 2171 - DNA, 25 bp, Homo sapiens
gatgaagtagttcattttgaatggt

SEQ ID NO: 2172 - DNA, 28 bp, Homo sapiens
ccccaactgcagctcctaaatattatac

SEQ ID NO: 2173 - DNA, 20 bp, Homo sapiens
ctttggagtctgcttgtacc

SEQ ID NO: 2174 - DNA, 20 bp, Homo sapiens
ctttggagtctgcttgtacg

SEQ ID NO: 2175 - DNA, 25 bp, Homo sapiens
ggaagatggtgcttgcaaagaagat

SEQ ID NO: 2176 - DNA, 22 bp, Homo sapiens
cgcttaacaaaggtgttagaac

SEQ ID NO: 2177 - DNA, 23 bp, Homo sapiens
acgcttaacaaaggtgttagaat

SEQ ID NO: 2178 - DNA, 23 bp, Homo sapiens
caggcagaagaataagggttgaa

SEQ ID NO: 2179 - DNA, 23 bp, Homo sapiens
gagagatagaggcaaaggaaaat

SEQ ID NO: 2180 - DNA, 23 bp, Homo sapiens
gagagatagaggcaaaggaaaag

SEQ ID NO: 2181 - DNA, 27 bp, Homo sapiens
ttcatctggttctcctctggatagtct

SEQ ID NO: 2182 - DNA, 19 bp, Homo sapiens
ggctgtcatttcagaagca

SEQ ID NO: 2183 - DNA, 19 bp, Homo sapiens
ggctgtcatttcagaagcg

SEQ ID NO: 2184 - DNA, 25 bp, Homo sapiens
gccttcagaacaatgcctgatacat

SEQ ID NO: 2185 - DNA, 15 bp, Homo sapiens
ctgtgcccttcctgg

SEQ ID NO: 2186 - DNA, 15 bp, Homo sapiens
ctgtgcccttcctgc

SEQ ID NO: 2187 - DNA, 21 bp, Homo sapiens
gaccctgagcccaaagaaact

SEQ ID NO: 2188 - DNA, 21 bp, Homo sapiens
aggatgtctgccattatttcc

SEQ ID NO: 2189 - DNA, 22 bp, Homo sapiens
caggatgtctgccattatttca

SEQ ID NO: 2190 - DNA, 27 bp, Homo sapiens
ggagacccaattgattaatgctcatgt

SEQ ID NO: 2191 - DNA, 17 bp, Homo sapiens
ccgtgtgcctgagaagt

SEQ ID NO: 2192 - DNA, 16 bp, Homo sapiens
cgtgtgcctgagaagc

SEQ ID NO: 2193 - DNA, 23 bp, Homo sapiens
gcccacagcatacagtaacacta

SEQ ID NO: 2194 - DNA, 19 bp, Homo sapiens
aggcagagtttccactcag

SEQ ID NO: 2195 - DNA, 19 bp, Homo sapiens
aggcagagtttccactcaa

SEQ ID NO: 2196 - DNA, 25 bp, Homo sapiens
aaggcctatgcccatgatttctact

SEQ ID NO: 2197 - DNA, 22 bp, Homo sapiens
gtgttcattgacagatgagtgt

SEQ ID NO: 2198 - DNA, 21 bp, Homo sapiens
tgttcattgacagatgagtgg

SEQ ID NO: 2199 - DNA, 30 bp, Homo sapiens
gtactctttatctggcttgttcatttagca

SEQ ID NO: 2200 - DNA, 19 bp, Homo sapiens
agcgatggccttaggtatc

SEQ ID NO: 2201 - DNA, 19 bp, Homo sapiens
agcgatggccttaggtatt

SEQ ID NO: 2202 - DNA, 25 bp, Homo sapiens
gtgtttccctgtgtgtgtgatgtat

SEQ ID NO: 2203 - DNA, 21 bp, Homo sapiens
ggaaagaaccacctcgatatg

SEQ ID NO: 2204 - DNA, 22 bp, Homo sapiens
gggaaagaaccacctcgatata

SEQ ID NO: 2205 - DNA, 26 bp, Homo sapiens
cctcgaggcccactgttttataatac

SEQ ID NO: 2206 - DNA, 21 bp, Homo sapiens
gtgtatgtgtgtgtgtgagaa

SEQ ID NO: 2207 - DNA, 21 bp, Homo sapiens
gtgtatgtgtgtgtgtgagag

SEQ ID NO: 2208 - DNA, 26 bp, Homo sapiens
tctaagccatccagtttgtggtactt

SEQ ID NO: 2209 - DNA, 24 bp, Homo sapiens
actgttactagagacaagggatac

SEQ ID NO: 2210 - DNA, 25 bp, Homo sapiens
aactgttactagagacaagggatat

SEQ ID NO: 2211 - DNA, 28 bp, Homo sapiens
ctctgaaatctgtcagttttgtttcatg

SEQ ID NO: 2212 - DNA, 29 bp, Homo sapiens
gttttctctttgttactaatatgtcacac

SEQ ID NO: 2213 - DNA, 29 bp, Homo sapiens
gttttctctttgttactaatatgtcacag

SEQ ID NO: 2214 - DNA, 30 bp, Homo sapiens
caagaaatctatcaacaggagcttggttat

SEQ ID NO: 2215 - DNA, 25 bp, Homo sapiens
gagatatcaattgaaaacggacatt

SEQ ID NO: 2216 - DNA, 25 bp, Homo sapiens
gagatatcaattgaaaacggacatg

SEQ ID NO: 2217 - DNA, 27 bp, Homo sapiens
caaggaatcctacctcaccttctcata

SEQ ID NO: 2218 - DNA, 20 bp, Homo sapiens
attgtgattggggaacttcc

SEQ ID NO: 2219 - DNA, 22 bp, Homo sapiens
gtattgtgattggggaacttca

SEQ ID NO: 2220 - DNA, 21 bp, Homo sapiens
ggagtcctggagagcagagtc

SEQ ID NO: 2221 - DNA, 20 bp, Homo sapiens
aggtagtttgttccacagca

SEQ ID NO: 2222 - DNA, 19 bp, Homo sapiens
ggtagtttgttccacagcg

SEQ ID NO: 2223 - DNA, 22 bp, Homo sapiens
ggcaacaccctcacagatacac

SEQ ID NO: 2224 - DNA, 22 bp, Homo sapiens
cattaaatgagttccactgcct

SEQ ID NO: 2225 - DNA, 20 bp, Homo sapiens
ttaaatgagttccactgccc

SEQ ID NO: 2226 - DNA, 25 bp, Homo sapiens
ctgtgcacgtggtaactaattgact

SEQ ID NO: 2227 - DNA, 21 bp, Homo sapiens
ttcttctgcctctctcataca

SEQ ID NO: 2228 - DNA, 20 bp, Homo sapiens
tcttctgcctctctcatacg

SEQ ID NO: 2229 - DNA, 29 bp, Homo sapiens
ggagattccaatggtgttagtcaatatgt

SEQ ID NO: 2230 - DNA, 20 bp, Homo sapiens
tgcaaaccatgctggattaa

SEQ ID NO: 2231 - DNA, 20 bp, Homo sapiens
tgcaaaccatgctggattag

SEQ ID NO: 2232 - DNA, 20 bp, Homo sapiens
gggccccttcagtcacagta

SEQ ID NO: 2233 - DNA, 24 bp, Homo sapiens
tcaacttttaaccagtactgttcc

SEQ ID NO: 2234 - DNA, 25 bp, Homo sapiens
ctcaacttttaaccagtactgttct

SEQ ID NO: 2235 - DNA, 26 bp, Homo sapiens
cgaattccttaagggcaccttatctt

SEQ ID NO: 2236 - DNA, 26 bp, Homo sapiens
ttgctaatactgcatttcttacaaat

SEQ ID NO: 2237 - DNA, 25 bp, Homo sapiens
tgctaatactgcatttcttacaaag

SEQ ID NO: 2238 - DNA, 23 bp, Homo sapiens
tgacacagaggcacaacataagc

SEQ ID NO: 2239 - DNA, 18 bp, Homo sapiens
tgtgccttacagaatccg

SEQ ID NO: 2240 - DNA, 20 bp, Homo sapiens
cttgtgccttacagaatcca

SEQ ID NO: 2241 - DNA, 21 bp, Homo sapiens
gagcagttgctcttcatcatc

SEQ ID NO: 2242 - DNA, 17 bp, Homo sapiens
ggagggtgaggtcaagc

SEQ ID NO: 2243 - DNA, 17 bp, Homo sapiens
ggagggtgaggtcaagg

SEQ ID NO: 2244 - DNA, 22 bp, Homo sapiens
tcatcttcctcttcctctgtgt

SEQ ID NO: 2245 - DNA, 19 bp, Homo sapiens
caccttgaccttggacttc

SEQ ID NO: 2246 - DNA, 19 bp, Homo sapiens
caccttgaccttggacttt

SEQ ID NO: 2247 - DNA, 28 bp, Homo sapiens
cagggtgctataacagaatgcaatagac

SEQ ID NO: 2248 - DNA, 20 bp, Homo sapiens
gttggaattgaggcttatgc

SEQ ID NO: 2249 - DNA, 21 bp, Homo sapiens
ggttggaattgaggcttatgt

SEQ ID NO: 2250 - DNA, 26 bp, Homo sapiens
ggaaggaatgaaagctttgggtttga

SEQ ID NO: 2251 - DNA, 16 bp, Homo sapiens
tcctgggagcctttga

SEQ ID NO: 2252 - DNA, 15 bp, Homo sapiens
cctgggagcctttgg

SEQ ID NO: 2253 - DNA, 20 bp, Homo sapiens
caaccatatcctggtgtgtg

SEQ ID NO: 2254 - DNA, 23 bp, Homo sapiens
acaaatcctttgacaatcactgt

SEQ ID NO: 2255 - DNA, 22 bp, Homo sapiens
caaatcctttgacaatcactgc

SEQ ID NO: 2256 - DNA, 27 bp, Homo sapiens
ctgctttcaaaccacaaattcatgtgt

SEQ ID NO: 2257 - DNA, 25 bp, Homo sapiens
ccttcaattctgaaaagtagctaat

SEQ ID NO: 2258 - DNA, 25 bp, Homo sapiens
ccttcaattctgaaaagtagctaag

SEQ ID NO: 2259 - DNA, 22 bp, Homo sapiens
tttgaggttgagtgacatgttc

SEQ ID NO: 2260 - DNA, 20 bp, Homo sapiens
agcccttcagaagaaaacag

SEQ ID NO: 2261 - DNA, 21 bp, Homo sapiens
cagcccttcagaagaaaacaa

SEQ ID NO: 2262 - DNA, 25 bp, Homo sapiens
gtgctggagcaatttggttcagata

SEQ ID NO: 2263 - DNA, 18 bp, Homo sapiens
ccctgctggagaaaatca

SEQ ID NO: 2264 - DNA, 18 bp, Homo sapiens
ccctgctggagaaaatcg

SEQ ID NO: 2265 - DNA, 21 bp, Homo sapiens
cgtgtgaggggacagagagaa

SEQ ID NO: 2266 - DNA, 22 bp, Homo sapiens
gtgctcactcagaataaaatgc

SEQ ID NO: 2267 - DNA, 23 bp, Homo sapiens
agtgctcactcagaataaaatgt

SEQ ID NO: 2268 - DNA, 21 bp, Homo sapiens
tgtgagagcaacagcttgaat

SEQ ID NO: 2269 - DNA, 24 bp, Homo sapiens
cccatgaatattgtacttaggaac

SEQ ID NO: 2270 - DNA, 24 bp, Homo sapiens
cccatgaatattgtacttaggaat

SEQ ID NO: 2271 - DNA, 19 bp, Homo sapiens
cctcccttgctcagtcact

SEQ ID NO: 2272 - DNA, 28 bp, Homo sapiens
ttattttcagagtcttgaatattattga

SEQ ID NO: 2273 - DNA, 29 bp, Homo sapiens
gttattttcagagtcttgaatattattgt

SEQ ID NO: 2274 - DNA, 22 bp, Homo sapiens
acagacagtggacagacaatct

SEQ ID NO: 2275 - DNA, 25 bp, Homo sapiens
cagcttgtacatcgtacttaacagt

SEQ ID NO: 2276 - DNA, 23 bp, Homo sapiens
gcttgtacatcgtacttaacagc

SEQ ID NO: 2277 - DNA, 20 bp, Homo sapiens
gccacgtggtaaaaatgact

SEQ ID NO: 2278 - DNA, 23 bp, Homo sapiens
gtgaaattactccttcatcaggg

SEQ ID NO: 2279 - DNA, 23 bp, Homo sapiens
gtgaaattactccttcatcagga

SEQ ID NO: 2280 - DNA, 24 bp, Homo sapiens
ctctttgacaatgcaatggtcact

SEQ ID NO: 2281 - DNA, 20 bp, Homo sapiens
caggcttttatgtgtgcatg

SEQ ID NO: 2282 - DNA, 22 bp, Homo sapiens
ttcaggcttttatgtgtgcata

SEQ ID NO: 2283 - DNA, 24 bp, Homo sapiens
gaagcaacaggagctctcattcat

SEQ ID NO: 2284 - DNA, 23 bp, Homo sapiens
atgcatgtcttggtatttatcca

SEQ ID NO: 2285 - DNA, 22 bp, Homo sapiens
tgcatgtcttggtatttatccg

SEQ ID NO: 2286 - DNA, 29 bp, Homo sapiens
ggtgctttctagttttggcaattatgagt

SEQ ID NO: 2287 - DNA, 23 bp, Homo sapiens
tgattggaagcatttcccataat

SEQ ID NO: 2288 - DNA, 22 bp, Homo sapiens
gattggaagcatttcccataac

SEQ ID NO: 2289 - DNA, 25 bp, Homo sapiens
ctaggttcctggaagcagctcttat

SEQ ID NO: 2290 - DNA, 18 bp, Homo sapiens
tcaggttggtcagtgctt

SEQ ID NO: 2291 - DNA, 18 bp, Homo sapiens
tcaggttggtcagtgctc

SEQ ID NO: 2292 - DNA, 25 bp, Homo sapiens
cttcaccgccatgtgactttatgaa

SEQ ID NO: 2293 - DNA, 18 bp, Homo sapiens
agccagcacagaccatct

SEQ ID NO: 2294 - DNA, 17 bp, Homo sapiens
gccagcacagaccatcc

SEQ ID NO: 2295 - DNA, 24 bp, Homo sapiens
atattggttactcacaggtgaaat

SEQ ID NO: 2296 - DNA, 20 bp, Homo sapiens
gggcaaaacccacagtaaaa

SEQ ID NO: 2297 - DNA, 20 bp, Homo sapiens
gggcaaaacccacagtaaag

SEQ ID NO: 2298 - DNA, 31 bp, Homo sapiens
gtgtttctgtttagcctgttagctatacaaa

SEQ ID NO: 2299 - DNA, 16 bp, Homo sapiens
ccaggatgagagggcg

SEQ ID NO: 2300 - DNA, 16 bp, Homo sapiens
ccaggatgagagggca

SEQ ID NO: 2301 - DNA, 29 bp, Homo sapiens
gggatgaaggattgaaggttagaacaatt

SEQ ID NO: 2302 - DNA, 28 bp, Homo sapiens
cacaactttctcatcttgattgaattta

SEQ ID NO: 2303 - DNA, 27 bp, Homo sapiens
acaactttctcatcttgattgaatttc

SEQ ID NO: 2304 - DNA, 18 bp, Homo sapiens
cggcatgtggcggtattc

SEQ ID NO: 2305 - DNA, 26 bp, Homo sapiens
gagaatctcaccagaatcaatataac

SEQ ID NO: 2306 - DNA, 27 bp, Homo sapiens
tgagaatctcaccagaatcaatataat

SEQ ID NO: 2307 - DNA, 21 bp, Homo sapiens
tcccaggattcgggctatacc

SEQ ID NO: 2308 - DNA, 26 bp, Homo sapiens
agaagcatgtgattatcattcaaatc

SEQ ID NO: 2309 - DNA, 27 bp, Homo sapiens
cagaagcatgtgattatcattcaaatt

SEQ ID NO: 2310 - DNA, 23 bp, Homo sapiens
gtcaagaaaggccctgcgtttat

SEQ ID NO: 2311 - DNA, 17 bp, Homo sapiens
acgccaatgaagactgc

SEQ ID NO: 2312 - DNA, 19 bp, Homo sapiens
gaacgccaatgaagactgt

SEQ ID NO: 2313 - DNA, 25 bp, Homo sapiens
ttcccttcgtcatcagtcacactta

SEQ ID NO: 2314 - DNA, 24 bp, Homo sapiens
aaatgaagactataagtgcacgat

SEQ ID NO: 2315 - DNA, 24 bp, Homo sapiens
aaatgaagactataagtgcacgaa

SEQ ID NO: 2316 - DNA, 37 bp, Homo sapiens
gtgggaccagttatgacaagaataatcattatagtac

SEQ ID NO: 2317 - DNA, 23 bp, Homo sapiens
gccactacttggttattttctgg

SEQ ID NO: 2318 - DNA, 23 bp, Homo sapiens
gccactacttggttattttctgc

SEQ ID NO: 2319 - DNA, 28 bp, Homo sapiens
aaactcccgttctatgatcgttgtagtt

SEQ ID NO: 2320 - DNA, 20 bp, Homo sapiens
ccggtgttgtttcagcatac

SEQ ID NO: 2321 - DNA, 20 bp, Homo sapiens
ccggtgttgtttcagcatat

SEQ ID NO: 2322 - DNA, 23 bp, Homo sapiens
gagaggcctggaacctcagatac

SEQ ID NO: 2323 - DNA, 23 bp, Homo sapiens
ctaattatgtccacagccactat

SEQ ID NO: 2324 - DNA, 23 bp, Homo sapiens
ctaattatgtccacagccactac

SEQ ID NO: 2325 - DNA, 21 bp, Homo sapiens
catccttggagtgaggacctg

SEQ ID NO: 2326 - DNA, 23 bp, Homo sapiens
aatttgacactagtcatagccat

SEQ ID NO: 2327 - DNA, 23 bp, Homo sapiens
aatttgacactagtcatagccaa

SEQ ID NO: 2328 - DNA, 21 bp, Homo sapiens
tggtggcacacacctatagtc

SEQ ID NO: 2329 - DNA, 25 bp, Homo sapiens
accaagcatgaacaggatatattac

SEQ ID NO: 2330 - DNA, 25 bp, Homo sapiens
accaagcatgaacaggatatattat

SEQ ID NO: 2331 - DNA, 27 bp, Homo sapiens
aacccagactggtttgatatagtatct

SEQ ID NO: 2332 - DNA, 19 bp, Homo sapiens
aagtccatcacatctcccc

SEQ ID NO: 2333 - DNA, 20 bp, Homo sapiens
gaagtccatcacatctccct

SEQ ID NO: 2334 - DNA, 23 bp, Homo sapiens
ccgtttttgttttttgttttgta

SEQ ID NO: 2335 - DNA, 18 bp, Homo sapiens
caaccctcattccagctc

SEQ ID NO: 2336 - DNA, 18 bp, Homo sapiens
caaccctcattccagcta

SEQ ID NO: 2337 - DNA, 20 bp, Homo sapiens
agtgctggagccaagataac

SEQ ID NO: 2338 - DNA, 14 bp, Homo sapiens
tccagcagccgcag

SEQ ID NO: 2339 - DNA, 14 bp, Homo sapiens
tccagcagccgcaa

SEQ ID NO: 2340 - DNA, 18 bp, Homo sapiens
cctggccacattcatcat

SEQ ID NO: 2341 - DNA, 17 bp, Homo sapiens
acacggtggcataagca

SEQ ID NO: 2342 - DNA, 16 bp, Homo sapiens
cacggtggcataagcg

SEQ ID NO: 2343 - DNA, 25 bp, Homo sapiens
tgatctgactccaagctgagtttac

SEQ ID NO: 2344 - DNA, 25 bp, Homo sapiens
actcactctgacttcagtttcttat

SEQ ID NO: 2345 - DNA, 25 bp, Homo sapiens
actcactctgacttcagtttcttaa

SEQ ID NO: 2346 - DNA, 24 bp, Homo sapiens
tgtactgaatggtgtcatttactc

SEQ ID NO: 2347 - DNA, 29 bp, Homo sapiens
ccctgaatttgactatattgattacatca

SEQ ID NO: 2348 - DNA, 28 bp, Homo sapiens
cctgaatttgactatattgattacatcg

SEQ ID NO: 2349 - DNA, 25 bp, Homo sapiens
actggggtttactgctccaattact

SEQ ID NO: 2350 - DNA, 20 bp, Homo sapiens
catccctgaatggaagtctt

SEQ ID NO: 2351 - DNA, 20 bp, Homo sapiens
catccctgaatggaagtctg

SEQ ID NO: 2352 - DNA, 28 bp, Homo sapiens
ccttggaatctagaaggccttttagtct

SEQ ID NO: 2353 - DNA, 22 bp, Homo sapiens
agtccacatcaggaaaatcagt

SEQ ID NO: 2354 - DNA, 21 bp, Homo sapiens
gtccacatcaggaaaatcagc

SEQ ID NO: 2355 - DNA, 30 bp, Homo sapiens
ccatttgccaatgagaaatatcaggttact

SEQ ID NO: 2356 - DNA, 24 bp, Homo sapiens
ccctggaataaggtaagaaatgag

SEQ ID NO: 2357 - DNA, 24 bp, Homo sapiens
ccctggaataaggtaagaaatgac

SEQ ID NO: 2358 - DNA, 22 bp, Homo sapiens
gttcacctggccagagatcaga

SEQ ID NO: 2359 - DNA, 19 bp, Homo sapiens
cccagtctccatccacttc

SEQ ID NO: 2360 - DNA, 19 bp, Homo sapiens
cccagtctccatccacttt

SEQ ID NO: 2361 - DNA, 26 bp, Homo sapiens
ctttgcatgttatctgccactgagat

SEQ ID NO: 2362 - DNA, 23 bp, Homo sapiens
ggaagtgcaccctacaatttaag

SEQ ID NO: 2363 - DNA, 23 bp, Homo sapiens
ggaagtgcaccctacaatttaac

SEQ ID NO: 2364 - DNA, 25 bp, Homo sapiens
cagtgacaagggaagattgacacat

SEQ ID NO: 2365 - DNA, 19 bp, Homo sapiens
caccctatccttcctcgat

SEQ ID NO: 2366 - DNA, 19 bp, Homo sapiens
caccctatccttcctcgac

SEQ ID NO: 2367 - DNA, 29 bp, Homo sapiens
gagggataaatacatcaatggcacaaaga

SEQ ID NO: 2368 - DNA, 22 bp, Homo sapiens
gtatttgggactacttcctgat

SEQ ID NO: 2369 - DNA, 22 bp, Homo sapiens
gtatttgggactacttcctgac

SEQ ID NO: 2370 - DNA, 22 bp, Homo sapiens
gcagggatgtcaagggactaga

SEQ ID NO: 2371 - DNA, 24 bp, Homo sapiens
tgctacaattatggaaaccctaaa

SEQ ID NO: 2372 - DNA, 24 bp, Homo sapiens
tgctacaattatggaaaccctaac

SEQ ID NO: 2373 - DNA, 25 bp, Homo sapiens
gtttgggatggcacaatgatttatg

SEQ ID NO: 2374 - DNA, 25 bp, Homo sapiens
gcaagagatgtatctcaactacaaa

SEQ ID NO: 2375 - DNA, 25 bp, Homo sapiens
gcaagagatgtatctcaactacaat

SEQ ID NO: 2376 - DNA, 25 bp, Homo sapiens
atcctccaatcttcctccccatatc

SEQ ID NO: 2377 - DNA, 19 bp, Homo sapiens
gccttgtgctatggagacc

SEQ ID NO: 2378 - DNA, 19 bp, Homo sapiens
gccttgtgctatggagact

SEQ ID NO: 2379 - DNA, 22 bp, Homo sapiens
ctctggcttgaagggcaaagac

SEQ ID NO: 2380 - DNA, 17 bp, Homo sapiens
ctgagttggaggtccat

SEQ ID NO: 2381 - DNA, 17 bp, Homo sapiens
ctgagttggaggtccac

SEQ ID NO: 2382 - DNA, 20 bp, Homo sapiens
tgccacatgcttcttctaac

SEQ ID NO: 2383 - DNA, 18 bp, Homo sapiens
ctcaaccagcttgacact

SEQ ID NO: 2384 - DNA, 18 bp, Homo sapiens
ctcaaccagcttgacacc

SEQ ID NO: 2385 - DNA, 28 bp, Homo sapiens
aaacagttcgaggatacacacaatctca

SEQ ID NO: 2386 - DNA, 27 bp, Homo sapiens
ggtcttctgagatggataaatattcaa

SEQ ID NO: 2387 - DNA, 27 bp, Homo sapiens
ggtcttctgagatggataaatattcag

SEQ ID NO: 2388 - DNA, 25 bp, Homo sapiens
gaaacagttggtcaaactgacaaga

SEQ ID NO: 2389 - DNA, 20 bp, Homo sapiens
aaccctcacaaccaccttac

SEQ ID NO: 2390 - DNA, 20 bp, Homo sapiens
aaccctcacaaccaccttag

SEQ ID NO: 2391 - DNA, 18 bp, Homo sapiens
tccatccaccgcttactg

SEQ ID NO: 2392 - DNA, 16 bp, Homo sapiens
gacaccacccagctca

SEQ ID NO: 2393 - DNA, 15 bp, Homo sapiens
acaccacccagctcg

SEQ ID NO: 2394 - DNA, 23 bp, Homo sapiens
tggctcagttctttttcttctat

SEQ ID NO: 2395 - DNA, 16 bp, Homo sapiens
atcagggcatcggagt

SEQ ID NO: 2396 - DNA, 14 bp, Homo sapiens
cagggcatcggagc

SEQ ID NO: 2397 - DNA, 20 bp, Homo sapiens
tcaagctgagggtggtctag

SEQ ID NO: 2398 - DNA, 23 bp, Homo sapiens
gcacatggcatgattctatttat

SEQ ID NO: 2399 - DNA, 23 bp, Homo sapiens
gcacatggcatgattctatttac

SEQ ID NO: 2400 - DNA, 20 bp, Homo sapiens
tgtccactcctggcacactt

SEQ ID NO: 2401 - DNA, 20 bp, Homo sapiens
gcagcaaaataacagtgtgc

SEQ ID NO: 2402 - DNA, 21 bp, Homo sapiens
tgcagcaaaataacagtgtga

SEQ ID NO: 2403 - DNA, 22 bp, Homo sapiens
gagcatattccccaccacagtt

SEQ ID NO: 2404 - DNA, 23 bp, Homo sapiens
cctgactcagcaattaatagtcg

SEQ ID NO: 2405 - DNA, 23 bp, Homo sapiens
cctgactcagcaattaatagtca

SEQ ID NO: 2406 - DNA, 22 bp, Homo sapiens
cattttgcacccaaccacaact

SEQ ID NO: 2407 - DNA, 26 bp, Homo sapiens
catctctacaaagctaaatcagacat

SEQ ID NO: 2408 - DNA, 24 bp, Homo sapiens
tctctacaaagctaaatcagacac

SEQ ID NO: 2409 - DNA, 24 bp, Homo sapiens
cctctcaagcaaatacgccttgaa

SEQ ID NO: 2410 - DNA, 16 bp, Homo sapiens
catggccatcgctcaa

SEQ ID NO: 2411 - DNA, 16 bp, Homo sapiens
catggccatcgctcac

SEQ ID NO: 2412 - DNA, 20 bp, Homo sapiens
gcaatgcacgtgaccatctt

SEQ ID NO: 2413 - DNA, 22 bp, Homo sapiens
tggcatactttcgatatactca

SEQ ID NO: 2414 - DNA, 22 bp, Homo sapiens
tggcatactttcgatatactcc

SEQ ID NO: 2415 - DNA, 25 bp, Homo sapiens
tggacatatgctattgactttaaaa

SEQ ID NO: 2416 - DNA, 20 bp, Homo sapiens
gactgtggtgtctgaaactc

SEQ ID NO: 2417 - DNA, 20 bp, Homo sapiens
gactgtggtgtctgaaactt

SEQ ID NO: 2418 - DNA, 17 bp, Homo sapiens
ggaggccctgccagatg

SEQ ID NO: 2419 - DNA, 22 bp, Homo sapiens
agaacttggggattttccatac

SEQ ID NO: 2420 - DNA, 23 bp, Homo sapiens
aagaacttggggattttccatag

SEQ ID NO: 2421 - DNA, 29 bp, Homo sapiens
gtcacagatcatttatcacagtgtaccat

SEQ ID NO: 2422 - DNA, 28 bp, Homo sapiens
cttttatggatctttctagtcttgtttc

SEQ ID NO: 2423 - DNA, 28 bp, Homo sapiens
cttttatggatctttctagtcttgttta

SEQ ID NO: 2424 - DNA, 26 bp, Homo sapiens
aagctagaggatggtcccagttttac

SEQ ID NO: 2425 - DNA, 15 bp, Homo sapiens
ccggctccatcacca

SEQ ID NO: 2426 - DNA, 15 bp, Homo sapiens
ccggctccatcaccg

SEQ ID NO: 2427 - DNA, 25 bp, Homo sapiens
ggcagaagtgacagtaggttagtct

SEQ ID NO: 2428 - DNA, 17 bp, Homo sapiens
aacagaaccaccttcct

SEQ ID NO: 2429 - DNA, 16 bp, Homo sapiens
acagaaccaccttccc

SEQ ID NO: 2430 - DNA, 24 bp, Homo sapiens
tgtgaaagaaccaactgaattaaa

SEQ ID NO: 2431 - DNA, 18 bp, Homo sapiens
gacagttcggtgaagtga

SEQ ID NO: 2432 - DNA, 18 bp, Homo sapiens
gacagttcggtgaagtgg

SEQ ID NO: 2433 - DNA, 22 bp, Homo sapiens
cgctgaactgaccgtctcattc

SEQ ID NO: 2434 - DNA, 20 bp, Homo sapiens
atgagaagaaggcctttctt

SEQ ID NO: 2435 - DNA, 19 bp, Homo sapiens
tgagaagaaggcctttctg

SEQ ID NO: 2436 - DNA, 20 bp, Homo sapiens
ttgtaccccaggttgaaaat

SEQ ID NO: 2437 - DNA, 22 bp, Homo sapiens
gtcgtaagtctctcctctctta

SEQ ID NO: 2438 - DNA, 21 bp, Homo sapiens
tcgtaagtctctcctctcttc

SEQ ID NO: 2439 - DNA, 20 bp, Homo sapiens
gggaacaggtgttcacatca

SEQ ID NO: 2440 - DNA, 22 bp, Homo sapiens
ccaataaaagtgactctcagca

SEQ ID NO: 2441 - DNA, 21 bp, Homo sapiens
caataaaagtgactctcagcg

SEQ ID NO: 2442 - DNA, 21 bp, Homo sapiens
ccaggtggtggattcttaagt

SEQ ID NO: 2443 - DNA, 21 bp, Homo sapiens
ggagcttcttcatttaccttc

SEQ ID NO: 2444 - DNA, 21 bp, Homo sapiens
ggagcttcttcatttaccttt

SEQ ID NO: 2445 - DNA, 18 bp, Homo sapiens
ttcctaggcccaaacaga

SEQ ID NO: 2446 - DNA, 18 bp, Homo sapiens
ctttctcagcaagagcac

SEQ ID NO: 2447 - DNA, 18 bp, Homo sapiens
ctttctcagcaagagcat

SEQ ID NO: 2448 - DNA, 27 bp, Homo sapiens
aagttggatcgagttataacaactata

SEQ ID NO: 2449 - DNA, 23 bp, Homo sapiens
agacattttctcaagatcatggc

SEQ ID NO: 2450 - DNA, 23 bp, Homo sapiens
agacattttctcaagatcatggg

SEQ ID NO: 2451 - DNA, 24 bp, Homo sapiens
cctgctttgcgtctgaagagatat

SEQ ID NO: 2452 - DNA, 32 bp, Homo sapiens
gatagatagatagatagatagagattttgagg

SEQ ID NO: 2453 - DNA, 32 bp, Homo sapiens
gatagatagatagatagatagagattttgaga

SEQ ID NO: 2454 - DNA, 20 bp, Homo sapiens
agcctgctgtcctgctctat

SEQ ID NO: 2455 - DNA, 18 bp, Homo sapiens
gaaagcagggtgagactg

SEQ ID NO: 2456 - DNA, 19 bp, Homo sapiens
ggaaagcagggtgagacta

SEQ ID NO: 2457 - DNA, 26 bp, Homo sapiens
ctgattttgctccaataggcactttt

SEQ ID NO: 2458 - DNA, 21 bp, Homo sapiens
aagtcaagaacatgctaagca

SEQ ID NO: 2459 - DNA, 20 bp, Homo sapiens
agtcaagaacatgctaagcg

SEQ ID NO: 2460 - DNA, 21 bp, Homo sapiens
ggtgtctcccaactttatgtg

SEQ ID NO: 2461 - DNA, 18 bp, Homo sapiens
tggtgctggagaattcag

SEQ ID NO: 2462 - DNA, 18 bp, Homo sapiens
tggtgctggagaattcaa

SEQ ID NO: 2463 - DNA, 21 bp, Homo sapiens
ggtgtctcccaactttatgtg

SEQ ID NO: 2464 - DNA, 20 bp, Homo sapiens
tccgaaactcatcattgaat

SEQ ID NO: 2465 - DNA, 20 bp, Homo sapiens
tccgaaactcatcattgaac

SEQ ID NO: 2466 - DNA, 25 bp, Homo sapiens
caaggttattgacagtgaacttact

SEQ ID NO: 2467 - DNA, 21 bp, Homo sapiens
gatgagtttcggaatgaccta

SEQ ID NO: 2468 - DNA, 19 bp, Homo sapiens
tgagtttcggaatgacctg

SEQ ID NO: 2469 - DNA, 22 bp, Homo sapiens
tttgaacctccagaatctacag

SEQ ID NO: 2470 - DNA, 17 bp, Homo sapiens
tggtagggtgaaccgga

SEQ ID NO: 2471 - DNA, 16 bp, Homo sapiens
ggtagggtgaaccggc

SEQ ID NO: 2472 - DNA, 21 bp, Homo sapiens
gggctacttcaccaaagagaa

SEQ ID NO: 2473 - DNA, 23 bp, Homo sapiens
ccatttcttaagactttctgctg

SEQ ID NO: 2474 - DNA, 23 bp, Homo sapiens
ccatttcttaagactttctgctc

SEQ ID NO: 2475 - DNA, 20 bp, Homo sapiens
cctgactggcaaggtttaaa

SEQ ID NO: 2476 - DNA, 19 bp, Homo sapiens
gtaagggatgagaaggatg

SEQ ID NO: 2477 - DNA, 20 bp, Homo sapiens
tgtaagggatgagaaggata

SEQ ID NO: 2478 - DNA, 19 bp, Homo sapiens
tgctgactccagctctttc

SEQ ID NO: 2479 - DNA, 27 bp, Homo sapiens
ccatcactggagtatttttagttatac

SEQ ID NO: 2480 - DNA, 27 bp, Homo sapiens
ccatcactggagtatttttagttatat

SEQ ID NO: 2481 - DNA, 24 bp, Homo sapiens
atattcggatctgttttcaactta

SEQ ID NO: 2482 - DNA, 24 bp, Homo sapiens
acatcacaagcatagcaaagatat

SEQ ID NO: 2483 - DNA, 23 bp, Homo sapiens
catcacaagcatagcaaagatac

SEQ ID NO: 2484 - DNA, 26 bp, Homo sapiens
gtggttgtctgcagttttcaaatgtt

SEQ ID NO: 2485 - DNA, 20 bp, Homo sapiens
agaatccgagaagtctgatg

SEQ ID NO: 2486 - DNA, 22 bp, Homo sapiens
gaagaatccgagaagtctgata

SEQ ID NO: 2487 - DNA, 26 bp, Homo sapiens
ttcagctttttattgaacacattata

SEQ ID NO: 2488 - DNA, 23 bp, Homo sapiens
gagttaacgtggacatgaagtag

SEQ ID NO: 2489 - DNA, 23 bp, Homo sapiens
gagttaacgtggacatgaagtat

SEQ ID NO: 2490 - DNA, 17 bp, Homo sapiens
cccagctgccaaatttc

SEQ ID NO: 2491 - DNA, 20 bp, Homo sapiens
tcatgaatgtccatttctgg

SEQ ID NO: 2492 - DNA, 20 bp, Homo sapiens
tcatgaatgtccatttctgc

SEQ ID NO: 2493 - DNA, 20 bp, Homo sapiens
tgacctgaacgacttcacag

SEQ ID NO: 2494 - DNA, 16 bp, Homo sapiens
ggcagtagtgcggttg

SEQ ID NO: 2495 - DNA, 17 bp, Homo sapiens
tggcagtagtgcggtta

SEQ ID NO: 2496 - DNA, 24 bp, Homo sapiens
ttcatccctggcttcacagtacat

SEQ ID NO: 2497 - DNA, 23 bp, Homo sapiens
cattagcctgggaaataaataac

SEQ ID NO: 2498 - DNA, 23 bp, Homo sapiens
cattagcctgggaaataaataat

SEQ ID NO: 2499 - DNA, 18 bp, Homo sapiens
cacccccacttgtcaaat

SEQ ID NO: 2500 - DNA, 15 bp, Homo sapiens
tgcccccagccagaa

SEQ ID NO: 2501 - DNA, 15 bp, Homo sapiens
tgcccccagccagag

SEQ ID NO: 2502 - DNA, 16 bp, Homo sapiens
ggccctccaggatctg

SEQ ID NO: 2503 - DNA, 25 bp, Homo sapiens
ttgtacatgaaaatacaggattaca

SEQ ID NO: 2504 - DNA, 24 bp, Homo sapiens
tgtacatgaaaatacaggattacg

SEQ ID NO: 2505 - DNA, 23 bp, Homo sapiens
tttgaacaggcactcactaatag

SEQ ID NO: 2506 - DNA, 18 bp, Homo sapiens
cacaggcagcagattctc

SEQ ID NO: 2507 - DNA, 19 bp, Homo sapiens
tcacaggcagcagattcta

SEQ ID NO: 2508 - DNA, 25 bp, Homo sapiens
gcacacacacgtcatcatatcttca

SEQ ID NO: 2509 - DNA, 20 bp, Homo sapiens
gcatagacaccatgttccct

SEQ ID NO: 2510 - DNA, 19 bp, Homo sapiens
catagacaccatgttcccg

SEQ ID NO: 2511 - DNA, 20 bp, Homo sapiens
gctctccctgtttcagacat

SEQ ID NO: 2512 - DNA, 21 bp, Homo sapiens
aagagaccatatcagaggcaa

SEQ ID NO: 2513 - DNA, 20 bp, Homo sapiens
agagaccatatcagaggcag

SEQ ID NO: 2514 - DNA, 20 bp, Homo sapiens
gcggacgggaagatgttgat

SEQ ID NO: 2515 - DNA, 27 bp, Homo sapiens
aattttcaaagttccttctctagaatc

SEQ ID NO: 2516 - DNA, 27 bp, Homo sapiens
aattttcaaagttccttctctagaatg

SEQ ID NO: 2517 - DNA, 26 bp, Homo sapiens
ctgtaagcagtttgggctcttttaat

SEQ ID NO: 2518 - DNA, 22 bp, Homo sapiens
cccgcaatgaactttaattctg

SEQ ID NO: 2519 - DNA, 22 bp, Homo sapiens
cccgcaatgaactttaattctc

SEQ ID NO: 2520 - DNA, 21 bp, Homo sapiens
ccagccaggcaaggttaagtc

SEQ ID NO: 2521 - DNA, 22 bp, Homo sapiens
agaatgttttcctccagttcac

SEQ ID NO: 2522 - DNA, 22 bp, Homo sapiens
agaatgttttcctccagttcag

SEQ ID NO: 2523 - DNA, 29 bp, Homo sapiens
caactactcttagaattaaaggcacagct

SEQ ID NO: 2524 - DNA, 28 bp, Homo sapiens
gaagaaatacttgacttgaagagaaatt

SEQ ID NO: 2525 - DNA, 28 bp, Homo sapiens
gaagaaatacttgacttgaagagaaatc

SEQ ID NO: 2526 - DNA, 25 bp, Homo sapiens
aggaagaaggctcctgtgttctaat

SEQ ID NO: 2527 - DNA, 16 bp, Homo sapiens
gctcccgttccactct

SEQ ID NO: 2528 - DNA, 16 bp, Homo sapiens
gctcccgttccactcc

SEQ ID NO: 2529 - DNA, 21 bp, Homo sapiens
gggagtggaacacaggtgaga

SEQ ID NO: 2530 - DNA, 16 bp, Homo sapiens
cagccaaggggtacca

SEQ ID NO: 2531 - DNA, 15 bp, Homo sapiens
agccaaggggtcacc

SEQ ID NO: 2532 - DNA, 17 bp, Homo sapiens
tgccagaggcgcatgtg

SEQ ID NO: 2533 - DNA, 25 bp, Homo sapiens
caatttaagccagaatcaggtaaac

SEQ ID NO: 2534 - DNA, 25 bp, Homo sapiens
caatttaagccagaatcaggtaaat

SEQ ID NO: 2535 - DNA, 22 bp, Homo sapiens
ggcaggcattctcaagaatcct

SEQ ID NO: 2536 - DNA, 20 bp, Homo sapiens
aaagtggacaaagcagtgat

SEQ ID NO: 2537 - DNA, 19 bp, Homo sapiens
aagtggacaaagcagtgac

SEQ ID NO: 2538 - DNA, 27 bp, Homo sapiens
gaactgaaatcctccaagtcgatctag

SEQ ID NO: 2539 - DNA, 17 bp, Homo sapiens
gaagcccacctatgcct

SEQ ID NO: 2540 - DNA, 15 bp, Homo sapiens
agcccacctatgccc

SEQ ID NO: 2541 - DNA, 19 bp, Homo sapiens
ccctcagccagccactatg

SEQ ID NO: 2542 - DNA, 20 bp, Homo sapiens
tcggtctcctttctgagttt

SEQ ID NO: 2543 - DNA, 20 bp, Homo sapiens
tcggtctcctttctgagttg

SEQ ID NO: 2544 - DNA, 30 bp, Homo sapiens
ggtcacttctagtctggtatccattatcat

SEQ ID NO: 2545 - DNA, 18 bp, Homo sapiens
tctgttccaccacctctt

SEQ ID NO: 2546 - DNA, 18 bp, Homo sapiens
tctgttccaccacctctc

SEQ ID NO: 2547 - DNA, 15 bp, Homo sapiens
cggcgctggtgagac

SEQ ID NO: 2548 - DNA, 19 bp, Homo sapiens
gacagaggcagagagagaa

SEQ ID NO: 2549 - DNA, 19 bp, Homo sapiens
gacagaggcagagagagag

SEQ ID NO: 2550 - DNA, 21 bp, Homo sapiens
tcctgctttgctctggtatca

SEQ ID NO: 2551 - DNA, 24 bp, Homo sapiens
acgcatctactttctgtctgtata

SEQ ID NO: 2552 - DNA, 23 bp, Homo sapiens
cgcatctactttctgtctgtatg

SEQ ID NO: 2553 - DNA, 22 bp, Homo sapiens
agtgtggagggaccctgataac

SEQ ID NO: 2554 - DNA, 21 bp, Homo sapiens
ggaaacttctctttgggactc

SEQ ID NO: 2555 - DNA, 21 bp, Homo sapiens
ggaaacttctctttgggactt

SEQ ID NO: 2556 - DNA, 24 bp, Homo sapiens
aagcttatggtggtcccagttagt

SEQ ID NO: 2557 - DNA, 511 bp, Homo sapiens
tggccctgtattgggtgctgggctaggatttccctgtggaagattgggaaggttggttacaaggtggctattttcctgtctcctctttgcgacagcacaccttctccatggtgtgtgccaggttcacgtgtactggtgatttaattttaacgttcatattatttttttctgggagagtttttgaaggctgccaggaggcaggactcgatgcaaacatgctccattctgtacccagccctgttgctggaaggatttkctgcacttacccagggaacaggcaagctcgtgctgtggctctgggctgtcacagctgctgtccacacctgggagagcaccctggatggctcatctgtgtacttgctttcttgttaaattgcagtgagttcacatgtgatttaatcggatcaaatggcctttacagactgataaaaatatggctgtttcaggtggtgttttgagctgctaagggcgtggcttttcactgagtacgtggtccccgttcctcagggaa

SEQ ID NO: 2558 - DNA, 511 bp, Homo sapiens
tcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcacatttttagattttttattggtaatctgagacaagaagaaatttaaagtaatcttcactaagccatgaaagctcccaacattgttctccrtgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagatgaggggatggcagaaaacatggaagcaaggtctctggtcagcccagggtgctgg

SEQ ID NO: 2559 - DNA, 1001 bp, Homo sapiens
tgctgggattacaggcgtgagccactgagcctggccaaaacctcagtctttattcttgaggtcttcactagttggacaaggcccactcacattctggagggcaatctgctttaccctaagtctactgatttaaacgttaaccacttcttaaaaataccttgacagcaatatccagattggtgtttgaccacataacctggccccataaccaaataggcacataaaatccattatagtaggtaagacttcgtcaaagaggtctagaaaacatttctgggagaaattaacgaagacccaaataaatgaagcgatatatcatgttcatggattggaagactcagtgcaagtattataaagatgtcagttctcttcaaattgatttttatatttaattcaatcacaaaataccatcagggagtgtgtgtgtgtgtgtgtgtgtgtgtgttgatattattctaaaatttatagggaaatacaaagcacccaaaatagcaagatagkcttgatgaatttgaaaaacaagttaaataacttataccaagaaatatcaagacttataaaattattaattaaaattatctgttattggcacacaaatggacaaatagcagtagaacagaacagatcatatgcatgtgtgcaatcccctgatttatgacaaggtgacattccatgcattgattaaaagacggtcttttcattaaattgtattgaatccattgaatattcatatttttatttagaagggtgtcaaactccactaccacatacatacacaaatacattacagatgcaagttcttggatctaaattagaaagggaagattatgaagcttttagaaggttaatgtaagagagaatatctgttttagcttgtggtaggcaaagattttctaaacaagatgcataaaacattaactataatgaaaaagataaataactggacttcattaaactttaaaacattcttattcattcaaatacatcagcgatggtttgac

SEQ ID NO: 2560 - DNA, 601 bp, Homo sapiens
tttaccaaaatattaaaaatactttgacagaaaaaaatcaagcgaactctttgccaaccaaatatcatcatgactgatgtaacaagtaatccaacacagatatgaaaatcactggtaaaaatcatctcagttaattctaaaagcagagctaaccaccccttttgtcctaaggctttatggtattaaaaaataaactgtacaaaaatatagattttcccctatcccctacccctggaaagtaatatactgaagtctcatcatactgttttggggattccagtaattaaaatctctagtgaayaaagacctgtttcaaaacaacctgtgagctgactggactatttaaagtaattctccttgtagtcactttcagagtgaagacaatgacgaatactgtcttttacaaagggactttttattccaccaacaaattctggattttggcatcaggaaaaccactgttcaatttccaacactatatccaagttgtttgagaaattatttaaaactctttaacttagagggttttctttctcctttacttgttaaagtgactatattacagagtcactttaaggattaaatttattgcatgcaaagt

SEQ ID NO: 2561 - DNA, 601 bp, Homo sapiens
atttagcatccagtaccttgatccacatgttcttctttgaagggtatttgatgggtatttagcatcccctgccttgatccacgtgtttttctttgaagggtatttgatgggtatttagcgtccagtaccttgatccacatgttcttctttgatgggcatttgatgggtatttagcatcccctgccttgatccacgtgttcttctttgttgggtatttgatgggtatttagcatgccatgccttgatccacctgttctttttagatgtctgcacccccagcccccactgctctttcaggtcrtcttatctacttgctttcatcagggaagtctgaccgtcccgctacagtagaagacctgaagaaacttcggtatctggaatgtgttattaaggagacccttcgcctttttccttctgttcctttatttgcccgtagtgttagtgaagattgtgaagtgggtaagtatgctatacctaaagtagaagggagagggaaactttctaatgtctaccttgctccggtctcataatgtattgactacttcttgacagcaggttacagagttctaaaaggcactgaagccgtcatcattccctatgc

SEQ ID NO: 2562 - DNA, 559 bp, Homo sapiens
tggttaacctaatttttgtgtttattgcttttaagaatttcattttgcaaatcaaaacagcaaatgcttgccatatggccagctagtacttaagcaaaatgaatgcacatcaccaccctgcattataaacccttttggttttagtatctctagcattttgtcatttatgtaaatgcagacatcggtaaaatgaggccagartgaaacgggtgaatctgaagcttttttggtgaatccatagtaaatgaaagacccactaagacataatctagggtagtgagtctcaagcttgaaggagctcaggatttatctggatcagctggagtacaaattctctgatcctccccagctatagatgtgcaaggtgggatcagggagggaaactcaagactcttcatctttaacaggtgttccaagccattctggttctccttccacctactgcgaaaatgtaaagtggctcgcttcctatgacaggacctcttgtttctcacatttggggtaaatctataactaaagcgatggtatctacattaatttgaaggtcaaaagtttgctg

SEQ ID NO: 2563 - DNA, 558 bp, Homo sapiens
tggccagctagtacttaagcaaaatgaatgcacatcaccaccctgcattataaacccttttggttttagtatctctagcattttgtcatttatgtaaatgcagacatcggtaaaatgaggccagagtgaaacgggtgaatctgaagcttttttggtgaatccatagtaaatgaaagacccactaagacataatctagggtagtgagtctcaagcttgaaggagctcaggayttatctggatcagctggagtacaaattctctgatcctccccagctatagatgtgcaaggtgggatcagggagggaaactcaagactcttcatctttaacaggtgttccaagccattctggttctccttccacctactgcgaaaatgtaaagtggctcgcttcctatgacaggacctcttgtttctcacatttggggtaaatctataactaaagcgatggtatctacattaatttgaaggtcaaaagtttgctgtgatggaagaaaagaccattctttcgtgcatcctgaggcacttttggatagaatccaaccagaaaagagaagag

SEQ ID NO: 2564 - DNA, 616 bp, Homo sapiens
ggatcagctggagtacaaattctctgatcctccccagctatagatgtgcaaggtgggatcagggagggaaactcaagactcttcatctttaacaggtgttccaagccattctgrttctccttccacctactgcgaaaatgtaaagtggctcgcttcctatgacaggacctcttgtttctcacatttggggtaaatctataactaaagcgatggtatctacattaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttg

SEQ ID NO: 2565 - DNA, 501 bp, Homo sapiens
tgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttcmctgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctg

SEQ ID NO: 2566 - DNA, 1001 bp, Homo sapiens
ggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggttttgtgtggccatcttggagcctgaagccccaggggctgacctggtctggggtgagcatgggkctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggcataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaat

SEQ ID NO: 2567 - DNA, 9275 bp, Homo sapiens
aggagctatccatacccatccattattcactgtgcctgcaagcaactctaataaaaaaaagttctgttagatgaggtttcaactacatgccactaaatactgggaatgttataagcattttttaaaatggaaacctgtgcataaactgtgtgaccctaaaatgaaattagggtccttttgagtgcagcatttttctacctttttttatgtatcatttacaaataaaaattatatatatctactgtgtacaagatagtgttttgatatacatgtacattgtgaaatgattaccatagtcaagctaattaacatgtccattattttacatagtgtgtgtgtgtgtgtgtgtgtgcgcatgtgtgtgtgctgagaacccatcagatctattctctagtgaagttcatgtatacgatacagtattatgaactatagtcaccatgtttgcattagtcagggttctctagaaggacagaactaataggatagatgtacatataaaggggagtttattaaagagtattgactcacacgatcacaaggtgaagtcccacaatagtctgcctgcaggctgaggagcaaggaagccagtctaagtcccaaaacctcaaaagcaagaaagtcaacagtgcagccttcagtctgtggtcaaaggtccaagagcccttggcaaaccactggtgtaactccaagagtccaaaagctgaagaacttggagtacaatgttcaagggcaggaaacatccagcacaggagaaagatgagggccagaagacttagccagtctagtccttccacgttcctctgcctgcttttatcctagcccggctggcagctgagatggtgcccacccagattgagggtgggtctgcctctcccagtcaactgactcaaatattaatctcctttggcaacaccctcacagacacatccaggaacaatacttggcatccttcaatccagtcaagccgacactcaatattaaccatcacaagtccaccccttgtctacttgaacccatacgcatctcctgaaatcatatataatcttcaaataaagataataataaggtcataattatgttaggtaatacataatacagctatccttcgtacaaccagaagtgtaccaatccccaacccaaatgctgttacataaagttaacaacatttaaatgctgatttgaagtaaataaatcttatgtcacatgataaaggaaaaagaaaggaaataaaatgaagatattttcttagtacaagtgtatacatacacaaacatgttcctaacaaaataaggaggaaatatgacaattacagtcctcatttctgcagctggtcacgtgggcatagccggtattgatgactaccttcttctactacccattctgtattccttttgccttcagcaagcatctcagcaggttgtggttttttacctggtggagtgacccaaacattcattcctaaggggtctgggccttatgtagcactgcctggattgggctgttgtagtttcccattgaccttaatcacagggcatggtaatactaagagttgcctgaagggatctcctgtattccttgcatactcttccttacctccactgtggagtaatagactaacttcatcttgatagtccaggtcaatcaccacagccaacactgcaactcccttctgagcctgttgacttagaggtaaaaggatctcaaagtgtccaggtggcaagcttaacttccagtttaatggaatccttgttgtgtcttctggtggcagcatttttccctctgaaactaacacaactaagcaagcagaaggtaatgtattgggaacaggaagcaaaaattttgctagtggatagctaggggtgatggtgagtggtgccacttccacttctgccccttgattcctagacctgtgaatcctggctatgggagaaacggtgccatatattggatgttgattcagagcatacatagccttctggagaattttgccccagccctgcaaagtattgtcccctagttggcattgtaattgtgacttcaaaaggccattccaccgttctatcaatacagctgcttcaggatgacgggaaacaatgttgtacattagatcctccaacttattcacactgcataattggaactttggaccttttgaccaaaaccaccccatagctggcactccccatactctggctaccaccattctactctctgttagcatgactttgacttttttagattctgcatgtagttgtaagtgcctctcttcagatgatcatatgatttttatccttcattttgtgaatgtggtatatagcatttattgagttgcatatgttgaaccatccttgcatcctaggctcagttgatcatgatccttttaatgtgttgttgaatttagtctggctaatattttcttcaggatttctggatctatgttcatcaggaatattgatctataattttaattttattttattgtgatgtccttgtttggctctgctatcaaagtaatgctggcctcattaaatgagattggaagtgtttcctccttttcaattatttgaaagagtttgagaaggattggtgttaattctttaaatgtttatagacttcaccaatgaagacatcaggtgctgagcttttcttagttgagagtttttatttctgattcaacctccttactcattattggtttgttcagattttctatttcttcctgattcagtcttggtaggttgtatgttcctaggaatttatctatttcttctacattatttaattagttgatgtactgtttttcatagtagtctcatgattttctgtatttctgtggtatccattgtaatctttcctccttcatttataattttatttgagttttttttctttttctcctaattaggctaaagatttcttgatttatctttttaaaaacaataacagtgtcattgaccttttctgttgtttttctagtctctatttcatttatctctgctctgatctttattattttctttcttcctctgtctttgggcttagttttttttttttactttcttattgcttcaggtgtaaagttaggatatttcagatctttccattttcttaaggtaggtatttatcgctataaacttccttcttagaactgcttttgctgcatcccataaattttcaatgccacaaattttgtttctcttttcatttttctcaagacattttttgattttccttttgatttcttctttgactcattggttgttcaggagtatgttaattttcatgtatttgtgaattttccatttttccttctgttactgagttctacttttatgccattatggttggaaaagatacttgatatgatttcaatccttaaatttgttaagatgttttccatggcctaacatataacctatcctggagagtgttctgtgtgcacttaaaaagaatgtgcattctgctgcttttgaaaggaatgttctgcacatgtccgttaggtctattggtttatagcattttgaaatccacagtttccttgttgattttctgtccaggtgatctattcattgttgaaagcatgttgctatttatttctcctttagttatgttaatatttgctttatagatttagatgcactgattttgggtacatgtgtatttacaattgttatatcctcttaatgaattcacccttttaccattatataatgaccttctctgtctcttgtgacagtatttgacttaaactctatctcatctgttataaggatagccacctctgctttcgtttggttatcatgtgaatgcaatctctttttcatcccttcacttccagcttatgtctgtccttaaagctaaagttagtctcttacaggcagcatatagttagatcttgttttttattcactcatccactctctcttttgattggataatttaatacatttacatctaaagtaattattggtaggtaaaggcttactactatcatgttgttaattgttttctgattgttttgtagttcctttgttgcttctttttgtctcactgtcttcctttgtgacttaataacttttttggagcaatttgctttggttcctttctctttatgttttgtatatctactacagactttttctttgtggttatcatgaggtttacataaaatatttcatagttataaccatccattttaatctggtaacaactttgactgcatttaaaaatactgtattttaacttctcctcctcccacattttattattcatgccatagtttatatcttttgtatgttgtgtattcattagcaaattgttgtagttatagttatttgttaatacttttgttttttaacttttatactagagttaaaagtgactgttgcacaataacagtattggagtattctgtatttgactgtataagaatacctttaatagagttttattctttcatttgttttcatgttagttagtgtccttttgtttaaacttgagaattccctttagcattttttgtaaggcaggtttaatggtgttgaaatcccacagcttttatttgtctggtgatatgatttgttcctgaacttccacccaaatctcatctcgaattgcaatccccaggtgtcaaaggagggacctgttgggagatgattggatcacgaggtgttttcccccattatgttctcatgatagtgagggtgttctcatgagatctgatggtttaaaagtggtggttacccgtgcgcacatgctctctctctctcctgctgccttgtgaagaaggtacctgcttccccttcaccttccaccataattgtaagtttcctgaggcctccccagccatgaggaactgtgagtcatttagacctcttttgtttataaattacccagtctcaggtgatatcttttagcagtgtgaaaataaacaatacagagaattggtactggcagagtgaggtactgctataaagacaacctgaaaatgtgaaggcaactttgaaactgggtaacaggcagaggttggaacagtttggagggcttagaagataggaagatgtgggaaagtttgaaacttcctagagacttgttgaatggttttgaccaaaatgctgatagtcgtattgacaatgaagtccaggctgagatggtctcagatggagacgagaaactattgggaactggagcaaaggccattcttgctatgctttagcagagactggcagcattttgcccctgccctagagatctgtggagctttgaacttgagagagatgatttagggtatctgtcagaataaatttctaagcagaaaagcattcaaatataacctggctttttctgaaagcatacagtcaagtcatatgcgttcacaaagagatggtatgaaattggaacttatgtttaaaagggaagcaaagcataaaagtttggaaattttgcagcctgaccatgtggtagaaaagaaaaaccaattttctgaggaggaattcaagccggctgcagaaatttacataagtaatcaggagctgaatgttaattgccaaacaatggggaaatgtctccagggcatttcagaggtcttcaaggcagcccctcccattacaagcccagaggcctaggagggaaaaatggtttcatgggccctgctgctctgtgcagccttgggacttggtgccctgtgccccagccactccagctccagctgtgactaaaagggtccatagctcaggctgtcgcttcaagggtgcaagccccaagccttggtggcttccacgtgctcttgggtctgcgagttcacagaaaacaagagctgagctttgagagcctctgcctagatttcacaggatgtgtggaaacacctggctgtccaggcagaagcctgctgcagggacccagccctcatggagaacctctattagggcagtgcagaggtgaactgtggggttggagcccacacacagagaccccactggagcactgcccagtggagctgtgaaaagagttcccccatcttccagatgccagaatggtagatccactgactggaaagttgcaggcactcagtgccggcccatgaaggcagccgtaggggctgtaccctgcaaagccacagggacagagctgcccaaggccttaacagcccacaccttgcatcagcatgccctgggtgtgagacaggggctccaaggagattattttggagctttaaaatttaatgacttccctgctaggttttgcatatgcttgggacctgtggcccctttattttggccaatttctcccatttggaatgggaacatttacccaattcctgtacccacattgtgttttggaagtaactaacttgttttttattttaaaggctcattgagggaagggacttgccttgtctcaaatgagactttggactcggacttttgggttactgtggaatgagttaagactttgggggactgttggaaagacatcattggttttgaaatctgaaaaggacatgagatttgggaaaggccaggggaagaatgatatggtttggctctgtgtcctcatccaaatctcgtcttgaattgtaatccccacatgggattacatgggaggggcctggtgagaggtgattggatcatggaggtggtttcccctgtgctgtgatctcatgatagtgagggatttaaaagtgacagtttcccctgcacatacacactctctctctcgtatcaccttgtgaagaaggtgtctgcttcccctctgccttccatcgtgattataagtttcctgaggcctccccagccatgggtaactgtgagtcagttaaacctcttttgtttataaattacccagtctcaggtagtatctttacagcagtgtgaaactggactaatacatctgggaaattctttttgtctccttcctttctgaaggacagctttgcctgatattatattcttggttgccaggttttgtactttcaatactttgaatatatcatcccactctctcttggcctacatgatttctgctgagaaatccaccaataatcttatgaagcttcccttgtatgtgaagaattgcttttctcttgcttctttgaaaattctctctttgtcatggtgaggatttcttttttttttttttttttttagatggagtctagctctgttgtccaggctggagtgcagtgtgcagtggcgcaatctcggctcactgcaagctccgtctcctgggttcacaccattttcctgtctcagcctctggagtagctgagactacaggtgcccaccaccacgcctggctaaattttttttgtatttttagtagagatggggtttcactgtgttagccaggatggtctcgatctcctgacctcatgatccacccatcttggcctcccaaagtgctgggattacaggcatgagccactgcacctggccgaggatctctttatatttaatctatttggagttcttttgggcttcataaatctggatgtttatttcatttatgtctccaaattttgagagttttctattcttatttttttaaataagtttctgcaactttctctttctctacttcttctggaactcttctaatgcatattaattttcttaacagtgtcctataagtcttgtcagctttctgcaatttttatcattccttttattactctgactgggtaatttcaaatgacctgtatctgagcatgctgattctttctcctgcttgatctagtctgctgctgaagctgtttgtgaattttttcaattcagtcattttgttctttagctccagaatttctgtttcattcttttttatggttcctatctatctttttgttgaacttctaattttgctcatgtattgttttcctgattttgtttactgtctatctatattgttttgtagcttattgagctttcttaaggcaattatttttagctcttgtcatgcagtaaagatctccatttctttagggtcacctcctgctgctttatttccttcctttggtggtttcttgtttccccgattatttgtgatcagtgtggccttgcactgaagtaggcacctatttcagtctttacatactagcttcagcagagaaagccattcactagtcagattgaccagagattgttggtgggctgtctgttggggtctatgcacaggatttctgctggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggttttgtgtggccatcttggagcctgaagccccaggggctgacctggtctggggtgagcatggggctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggyataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaa

SEQ ID NO: 2568 - DNA, 629 bp, Homo sapiens
tttattcaagcaagcaacttatttcatttccttgtttgctacagtttcctgtggtaagtgaattatctataaaacatggaattcaggctaagacaggagtagccaagcaagtggcaccacccctggagaaagctattgaacatacagcttcgggggtggagattgtccctgatgattcaggacacrtgtctatttaatgttccacaacaaggaccacttgtcaggtatattgctgtagacatatgttgcagaccagaggaaggagctcagaagtaggaatgtcttgggacttgtgttaacaaaaacttctgttcgcagatgacactctgcaaagcaaaacttgaaacaaaaaaaaattagtcctctatttttattatcaacagtaaaaaattaaactttatctgaaaattcaaaagagtgctaggcattttatagtgtctgggtccaatccaagtatctgttaggaacaccatacatagttttactctggaccgctagggaaccatttcaaaaatgaaagtaactggtttaaatttaacttagcaaaccatgcatttggatagttctaggtgaatagctttcaacaccagatttagatctcatttctctattaatttcattaatttttg

SEQ ID NO: 2569 - DNA, 701 bp, Homo sapiens
caagaaatttgaatctttaaaaaaaaaagaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcgtggtggcgcgcgcctgtagtcccagctactcgggaggctgaggcaggagaatggcgtgaacccgggaggcggagcttgcagtgagtcgagatcgcgccactgcgctccagcctgggcgacagagcgagactccgtctcaaaaaaaaaaaaaaaaaaaagagcctaattttgcttcactgtctgtgaaaagaattatctgtatcttttgcatgtaagacaaatctcaatgaaaagggtgcttaaatagaagttaacactattttaaagcaagaatggaagtggtttcatcatgcgtaaacaacaactctccacattttgtaatgattgakctggatgcaatttgtcatcagacaggagaagtcgaaagcaaagaaataacactgggagatagagaagctctttcattcaatgcgaaaggtcaaaggcacatcagtttctttaataatgcaaacctcagcacacattatcagtgtcctcattattattgccttgtttatttcccactgctcattgataatttcaacgtgaa

SEQ ID NO: 2570 - DNA, 511 bp, Homo sapiens
ttccctgtggaagattgggaaggttggttacaaggtggctattttcctgtctcctctttgcgacagcacaccttctccatggtgtgtgccaggttcacgtgtactggtgatttaattttaacgttcatattatttttttctgggagagtttttgaaggctgccaggaggcaggactcgatgcaaacatgctccattctgtacccagccctgttgctggaaggatttgctgcacttacccagggaacaggcaagctsgtgctgtggctctgggctgtcacagctgctgtccacacctgggagagcaccctggatggctcatctgtgtacttgctttcttgttaaattgcagtgagttcacatgtgatttaatcggatcaaatggcctttacagactgataaaaatatggctgtttcaggtggtgttttgagctgctaagggcgtggcttttcactgagtacgtggtccccgttcctcagggaacacccagtagccacatgcctcctaaacct

SEQ ID NO: 2571 - DNA, 601 bp, Homo sapiens
aagcaaaagaaatactagaagacacttgatttttctcaaaaataaacacaccaagtatttttgttttagtgaaattcatgcttacatgctgtatactaggattgaacatactgccaccaaaatatagcagtcggtggtacatgtgggtggagcaagacccctccaccttgtcatcgtgtgaaggggctctgccatacatgaccttgcatgtgactttaaggtggttggcctggaagaaaagtcccaagatgggaaatagtaggtgtcttttttactaaatgcactccaatttgggaccaaraattttcattcttgaaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaattttggatgtacttagtatacattcatcttttaaataatctatttacattttcatactttccaaaatacagatatattttattttattt

SEQ ID NO: 2572 - DNA, 801 bp, Homo sapiens
gatttctttgttagatttatttcagatagaaaaggggatacgaaaaatgcaggcacatgagatacttggagaactttaagaaagagtgagtgtgtgtgtgtgtgtgtgtgtgtgtgtgtgtgtgtctggcaagcaaggtcttgcacacacacagcactttgggaggccaatgcaggtggatcacttgagcctaggaatttgagaccagtctgggcaatgtgatgaaacccatctctacaaaaaaatatgaaagtatctgtgtgtgtgtgttgctgtgtagtggactacagaactttagaggcagtcacttatttgaatcccattgtcgtaactttctactattttatttttccactgtgactcagggagattcaggtggtcccttagtttgcaaacacaayggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataa

SEQ ID NO: 2573 - DNA, 601 bp, Homo sapiens
gctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggtcgaggttccagcacagttcctgggatccctctaattgcactgcttcctctggaactcagtatatctcaaagatgtaatttcctctccgtgctgcacctggtcggccactgaaacccactattgccygcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctcgaggggctgcagcattgcacagccttcatggcaggcaaggaatctgctttgcaaggggcattagccctggaggctcagtggatatgggctattgcaatagtaattcaaggagcattt

SEQ ID NO: 2574 - DNA, 801 bp, Homo sapiens
agatgagaacacagatttggttattagagatcagataatttttaaatccttatgtgatagatttatccttgaaatatttcaaaatccagtatggagcaggataagactttttacatgagtattttgtcttaggtaaggaactgttatttagagagagagagagtaggtttttatttttattctgttagactgtaacattttttagactgggaagggcactgacaatcataccaattgcagctgtttcaaaagtgccaatttaaaagtgtagcgcttttgaaattagccaagtatatatatttttctgacagtgttattaaaagatagactccttaccataaatgaaatgcatccaaattaggctttaagtgtatttttcatgaagaaaactaggagtactwttatagaaatgtcttttaggggttcaaaataaattctggcataaagttgatggcaaaagctttttagtaaatcacgattctgtttttcatcgaccactcgaatgtcctgggactcactcaccgatgctccaggctgggaaactgccttgtggcgtacgtgaaaaagtggcagtggacgtcatccgtgcatctttcttggcattcttgagcactcttggcaactgagctgttatagtttatgcccttcatgtctaggtccacataaatgtctttgttgcaagctggaaataaaagcagaagacatgagtaccttccagattctaggggcaatgacctaagcaactgtccctcctgactcatcctttcaactttttcacccacctttcctcagaggtctttc

SEQ ID NO: 2575 - DNA, 511 bp, Homo sapiens
tggacaatggctgcagcctgcgggcaaggtgcttgccttttctttctaagagcagttctcaaacgccagcagggctggttcaaacacagatggctgagcttccaggctggagtttctcattcactggatctgaggttgggctgaagaatgtgcatttctaacacgttcccaggtgacgctgttggtctggggactgcacttgacaaccactggtttaaaaacaccattcacgttatcatttgaaggagggtaagasagccttgtagtaccacacaaggagggctacattcttaggggtgtgtaattacaagatgacttagtcaattccatttttcatgtgcatgttttgctttggcagcttgattataaagtctctgtaactcagggtcatgataaactattgacttgaggaaaggttttcttcttgttcctgaaggagcataattactgatggaaaggaagatgtaggaagctgctcatcacaatgcttctgttgcagagtgtaccacca

SEQ ID NO: 2576 - DNA, 745 bp, Homo sapiens
tgtaccagaagagtgcacattctacacactgcgtagcacctttctcacttacgttctgtctgggcacacttctgattgacacgcagagggctctctctgtctggggatatttctgatgggtaccgagagagcttcctctatcttgggttatttctgatgcgtagagaagggctgcctctgtccattatggaaggctggtgttcactgcagggattccacacttcatttaaccagagtccccgtggacggacacttgggttgttttcaatctttccckctttcatacacacgcaggaacatttgtaggataaagtccagatgtagaattgctgaagacaaaacaaaacgaaaacagcagatgcatttgtaattttgaatattgccaaatttctcttcaaaaatctgtagccattttttctcccaccagcaatgtaagagagggccacgttccagctaccataacaccacaattaggaatttttgacaatctgacaggtggaaaaaggtagctcactgtagattattttgcagttctcttactatgacaaattaatataaatgacgtgatgttaatgtggtgtataagatcaccaaattgttcaccgcttcattgtttacttaaatgctaatttggtggttatgacgtagacaaacatagagtatgctccttgcagtcatgtaaacatggtaagagttcttgccaaaggacgaagcaaacgttccagagcttatgttgttcaagctt

SEQ ID NO: 2577 - DNA, 701 bp, Homo sapiens
gtccagggctttgcagatggtttggaatttccctatcagtgcacttgaacacctttatggaggtctgtcctgtggcataattcagattccagagccacagtagaagaggtttcaccagatttgtattcacgttgctgaatctcagtccacccatctctagctggaaatagactacaaagtccctttgtgatactaacagtrtataggcacttacacttttgaaattaggcaatgtgagttctccaacttaattctctttttccatataattttggctattcttattcttattttacagaggagaagactgaggcacatagaggttaaaaattagaggagaagcgagtaagaagtaggctagaaaatcaaatccatagcatctgctcctgaatctacacctttccccaccacctgaggaatcagctaataatggcttccgaactaaatctggcctgctgtctttgtaaataaagttttattggaacacagccataaccattcattgacacatcacatatggtgcttttgctctataacaacagagttgagtaatcgaaggggcgatcctgtggttcacaaagcctaaaatatttactacctggtgctttcccagaaaagtgtgctgatcccagcactgcgctgtactgactgccattataatcatacatgcctcaaggccattttgaaaacaaataatgcaa

SEQ ID NO: 2578 - DNA, 619 bp, Homo sapiens
gctccccagcacatcagttttggtccatcagaaacagaacattagagaagactctcaatattgctcatgttagaataaagccagcttcttttctattaaaaaaatgcttgtccaactcgcgtgaggtttgtcagcgaygcagaggaggggcttttgttgttgcaggggtcatacttttccatttgtttttcctcgtggaattttctccagctctcccatttaacactgcgtgccccgccccagcctggccccatgcaatgctttggtgctccagggttgccggtggtcctgcagggtctgcagtcacacaggtctctctcctggaggcagagtccctgtgggtctcagccatgttcttggtcaaatgcagaagtgaaaacaaagcatttcaatatttattgaattaccctatttgctagcctgcattttcattttcaatttatttttacacatatttgatacctatcatgggttgggtacagagctaggttccaagaggaaaacagtaaggaaaaagcattcctgttcctgataagtagtaatctctattaagaaagttcaatgaggacagaaagaaatatcacaaataattgtagtgcaagcagaatcatgtcgttcc

SEQ ID NO: 2579 - DNA, 795 bp, Homo sapiens
tcctaacagaaacccaggctcagaacaatgaagcgagttgtccttgggcgtgccaatggttgtcagacgttcttttccatcggaatcacctggagggtttgttactactgggctccatccctggagtttctgactgggtagatttgggatggagaattggtgtctccaacaatttcccaggcgcctctgctgctgctggttcaggagccacactctgagaagcacggggaagcaggtgaatgttgggaagacattctgcaagacaggagtggcagaggcgacattctcatggtggagaaaaggaacaaagcacccgagacagtcctggaactgcttcctgccagtccacttgctgtagaatcagccgctgtgggaggagtgaaggcatggggccaggagcttgacgttctgaattggaatcttccctctaccatttactgactgggtcatcttgggcaacttactgacccattccgtgacgcagttcccataagacggggmtggtgatgacaatagttacctaagtcactgtgagggttaaacgagtcgtagaaagtacattttgaggagtgcttggcatattttaggtgtacaaagtatcctattagagataaatcagctgctcttttcgttcttctgatggattgctaatgaacaaatatccatgaaggaagaaaaccagttgtagctttttgtggttcaggagaagggctgccatgtctctttggacaaaatttgtatctactctaaggcatacaaaacagtgccaagagaatacattttaaaatgagcttt

SEQ ID NO: 2580 - DNA, 1001 bp, Homo sapiens
aggatttgtgaggtggaaggaaaggatggatgggtggaacacgaggtttttagggctgtgaaattattcagcatgatgctataatgacggttgtatgtcattatacatttgtcaaaacccataacatctacatgtaaccaagagttagccctaatgtaaactacagattttagctaagaatcatgtaacaatatgttcatcagttttaacaaatgtcctccgctaatgcaagatgttaggagaacctggaagggtaggagaagaatacataagaaccctctgtattttatgcttaatttttctgcaaatctaaaactgctctataaaataaagtctactaatttttaaaagtgtacaccgatttggaaataagtcctactacacaaaacgtgatgggtaagcctgaactccgggtccagactgcttgagtgagctgggacaaatgacgtgtggaaaatagcaggaacagtgcctggccatagggctggtttgaaagggcakatgaaaatctatggggagcagatggccaagtgcctccagatggttataacattagatagagttctcataagataatttctactagtaagaaccactcacaatgggactcggctctcttctgaaatagtttcatgtcgctcaagtatccaagcacagactgatggatgaattcagtattcagtattggttttgaaaagaaacacggcattataaggatgatcaaatagtacgttctgtaatgtgctggaattttgggatcgtctgaaagaaggtgacatgtaaaaccacttaggagattgtaaaagccaaacattcaagacgttgtttgtgaggatcgtcttttttttttactgcacatttcagctcattgtcaaacaaatttctacagagccttggaattatatagtatcagcattggagaaaacatcagtgctcataaaatcagccgcactttacagatgtggagtaagaggtgctcaaagattgagtttccctggtca
